(12) United States Patent
Maeder et al.

(10) Patent No.: US 11,028,388 B2
(45) Date of Patent: Jun. 8, 2021

(54) CRISPR/CAS-RELATED METHODS AND COMPOSITIONS FOR TREATING USHER SYNDROME AND RETINITIS PIGMENTOSA

(71) Applicant: EDITAS MEDICINE, INC., Cambridge, MA (US)

(72) Inventors: Morgan L. Maeder, Jamaica Plain, MA (US); David A. Bumcrot, Belmont, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 313 days.

(21) Appl. No.: 15/123,576

(22) PCT Filed: Mar. 5, 2015

(86) PCT No.: PCT/US2015/019064
§ 371 (c)(1),
(2) Date: Sep. 2, 2016

(87) PCT Pub. No.: WO2015/134812
PCT Pub. Date: Sep. 11, 2015

(65) Prior Publication Data
US 2017/0073674 A1    Mar. 16, 2017

Related U.S. Application Data

(60) Provisional application No. 61/948,520, filed on Mar. 5, 2014.

(51) Int. Cl.
| | | |
|---|---|---|
| *C12N 15/113* | (2010.01) | |
| *C12N 9/22* | (2006.01) | |
| *C12N 7/00* | (2006.01) | |
| *A61K 38/46* | (2006.01) | |
| *A61K 47/26* | (2006.01) | |

(52) U.S. Cl.
CPC .......... *C12N 15/113* (2013.01); *A61K 38/465* (2013.01); *A61K 47/26* (2013.01); *C12N 7/00* (2013.01); *C12N 9/22* (2013.01); *C12Y 301/00* (2013.01); *C12N 2310/10* (2013.01); *C12N 2310/20* (2017.05); *C12N 2320/34* (2013.01); *C12N 2750/14143* (2013.01)

(58) Field of Classification Search
CPC ....... C12N 15/907; C12N 15/63; A61K 48/00
See application file for complete search history.

(56) References Cited

U.S. PATENT DOCUMENTS

| | | |
|---|---|---|
| 5,443,505 A | 8/1995 | Wong et al. |
| 5,766,242 A | 6/1998 | Wong et al. |
| 6,251,090 B1 | 6/2001 | Avery et al. |
| 6,299,895 B1 | 10/2001 | Hammang et al. |
| 6,413,540 B1 | 7/2002 | Yaacobi |
| 6,416,777 B1 | 7/2002 | Yaacobi |
| 6,586,240 B1 | 7/2003 | Singer et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,394 B2 | 11/2014 | Chalasani et al. |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,163,259 B2 | 10/2015 | Choi et al. |
| 9,322,037 B2 | 4/2016 | Liu et al. |
| 9,499,847 B2 | 11/2016 | Porter et al. |
| 2003/0186238 A1 | 10/2003 | Allawi et al. |
| 2007/0020627 A1 | 1/2007 | Barbas |
| 2010/0055793 A1 | 3/2010 | Chandrasegaran et al. |
| 2010/0055798 A1 | 3/2010 | Battersby |
| 2010/0076057 A1 | 3/2010 | Sontheimer et al. |
| 2011/0059502 A1 | 3/2011 | Chalasani |
| 2011/0189776 A1 | 8/2011 | Terns et al. |
| 2011/0223638 A1 | 9/2011 | Wiedenheft et al. |
| 2011/0236894 A1 | 9/2011 | Rao et al. |
| 2011/0301073 A1 | 12/2011 | Gregory et al. |
| 2012/0270273 A1 | 10/2012 | Zhang et al. |
| 2013/0130248 A1 | 5/2013 | Haurwitz et al. |
| 2013/0253040 A1 | 9/2013 | Miller et al. |
| 2014/0068797 A1 | 3/2014 | Doudna et al. |

(Continued)

FOREIGN PATENT DOCUMENTS

| | | |
|---|---|---|
| WO | 2000/040089 A1 | 7/2000 |
| WO | 2001/028474 A1 | 4/2001 |

(Continued)

OTHER PUBLICATIONS

Tucker et al.; Patient-specific iPSC-derived photoreceptor precursor cells as a means to investigate retinitis pigmentosa; eLife 2013; 2:e00824; pp. 1-18, published Aug. 27, 2013 (Year: 2013).*
Aller et al. (The USH2A c.2299deIG mutation: dating its common origin in a Southern European population; European Journal of Human Genetics; vol. 18, pp. 788-793, published online Feb. 10, 2010 (Year: 2010).*
Joung, J., et al., "Genome-Scale CRISPR-Cas9 Knockout and Transcriptional Activation Screening," Nat. Protoc. 12(4):828-863 (2017).
Koike-Yusa, H., et al., "Genome-Wide Recessive Genetic Screening in Mammalian Cells with a Lentiviral CRISPR-Guide RNA Library," Nat. Biotechnol. 32(3):267-273 (2014).
Shalem, O., et al., "Genome-Scale CRISPR-Cas9 Knockout Screening in Human Cells," Science 343:84 (2014).

(Continued)

*Primary Examiner* — Antonio Galisteo Gonzalez
(74) *Attorney, Agent, or Firm* — Perkins Coie LLP; Patrick D. Morris; Courtney Prochnow

(57) ABSTRACT

CRISPR/Cas-related compositions and methods for treatment of Usher Syndrome and/or Retinitis Pigmentosa are disclosed herein.

22 Claims, 26 Drawing Sheets
Specification includes a Sequence Listing.

(56) References Cited

U.S. PATENT DOCUMENTS

| | | |
|---|---|---|
| 2014/0179770 A1 | 6/2014 | Zhang et al. |
| 2014/0242699 A1 | 8/2014 | Zhang |
| 2014/0309177 A1 | 10/2014 | Perez-Pinera et al. |
| 2014/0315985 A1 | 10/2014 | May et al. |
| 2014/0335620 A1 | 11/2014 | Zhang et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356958 A1 | 12/2014 | Mali et al. |
| 2015/0056705 A1 | 2/2015 | Conway et al. |
| 2015/0232833 A1 | 8/2015 | Mali et al. |
| 2015/0259704 A1 | 9/2015 | Church et al. |
| 2016/0281111 A1 | 9/2016 | Cotta-Ramusino et al. |
| 2016/0340661 A1 | 11/2016 | Cong et al. |
| 2017/0073674 A1 | 3/2017 | Maeder et al. |

FOREIGN PATENT DOCUMENTS

| | | |
|---|---|---|
| WO | 2002/089767 A1 | 11/2002 |
| WO | 2003/072788 A1 | 9/2003 |
| WO | 2008/108989 A2 | 9/2008 |
| WO | 2010/054108 A9 | 5/2010 |
| WO | 2011/012724 A1 | 2/2011 |
| WO | 2011/143124 A2 | 11/2011 |
| WO | 2011/146121 A1 | 11/2011 |
| WO | 2012/145601 A2 | 10/2012 |
| WO | 2012/164565 A8 | 12/2012 |
| WO | 2013/012674 A1 | 1/2013 |
| WO | 2013/066438 A2 | 5/2013 |
| WO | 2013/082519 A2 | 6/2013 |
| WO | 2013/098244 A1 | 7/2013 |
| WO | 2013/141680 A1 | 9/2013 |
| WO | 2013/142578 A1 | 9/2013 |
| WO | 2013/163628 A2 | 10/2013 |
| WO | 2013/176772 A1 | 11/2013 |
| WO | 2013/181228 A1 | 12/2013 |
| WO | 2014/018423 A8 | 1/2014 |
| WO | 2014/022702 A2 | 2/2014 |
| WO | 2014/036219 A2 | 3/2014 |
| WO | 2014/059255 A1 | 4/2014 |
| WO | 2014/065596 A1 | 5/2014 |
| WO | 2014/089290 A1 | 6/2014 |
| WO | 2014/093479 A1 | 6/2014 |
| WO | 2014/093595 A1 | 6/2014 |
| WO | 2014/093622 A8 | 6/2014 |
| WO | 2014/093635 A9 | 6/2014 |
| WO | 2014/093655 A2 | 6/2014 |
| WO | 2014/093661 A2 | 6/2014 |
| WO | 2014/093694 A1 | 6/2014 |
| WO | 2014/093709 A1 | 6/2014 |
| WO | 2014/093712 A1 | 6/2014 |
| WO | 2014/093718 A1 | 6/2014 |
| WO | 2014/099744 A1 | 6/2014 |
| WO | 2014/099750 A2 | 8/2014 |
| WO | 2014/124284 A1 | 8/2014 |
| WO | 2014/144288 A1 | 9/2014 |
| WO | 2014/144592 A2 | 9/2014 |
| WO | 2014/144761 A2 | 9/2014 |
| WO | 2014/152432 A2 | 9/2014 |
| WO | 2014/186585 A2 | 11/2014 |
| WO | 2014/197568 A2 | 12/2014 |
| WO | 2014/197748 A2 | 12/2014 |
| WO | 2014/204578 A1 | 12/2014 |
| WO | 2014/204725 A8 | 12/2014 |
| WO | 2015/006290 A1 | 1/2015 |
| WO | 2015/006294 A2 | 1/2015 |
| WO | 2015/006498 A2 | 1/2015 |
| WO | 2015/013583 A8 | 1/2015 |
| WO | 2015/020522 A1 | 2/2015 |
| WO | 2015/021353 A1 | 2/2015 |
| WO | 2015/027134 A1 | 2/2015 |
| WO | 2015/035136 A8 | 3/2015 |
| WO | 2015/035139 A2 | 3/2015 |
| WO | 2015/035162 A2 | 3/2015 |
| WO | 2015/048577 A2 | 4/2015 |
| WO | 2015/048680 A1 | 4/2015 |
| WO | 2015/070083 A1 | 5/2015 |
| WO | 2015/071474 A9 | 5/2015 |
| WO | 2015/077290 A2 | 5/2015 |
| WO | 2015/077318 A1 | 5/2015 |
| WO | 2015/089406 A1 | 6/2015 |
| WO | 2015/099850 A1 | 7/2015 |
| WO | 2015/195621 A1 | 12/2015 |
| WO | 2016/022363 A9 | 2/2016 |
| WO | 2016/073990 A2 | 5/2016 |
| WO | 2016/182959 A1 | 11/2016 |
| WO | 2016/186772 A2 | 11/2016 |
| WO | 2016/205749 A1 | 12/2016 |
| WO | 2017/035416 A2 | 3/2017 |
| WO | 2017/044649 A1 | 3/2017 |
| WO | 2017/184768 | 10/2017 |
| WO | 2018/126176 A1 | 7/2018 |

OTHER PUBLICATIONS

Bothmer, A., et al., "Characterization of the Interplay Between DNA Repair and CRISPR/Cas9-Induced DNA Lesions at an Endogenous Locus," Nat. Commun. 8:13905 (2017).

Chen, F., et al., "Targeted Activation of Diverse CRISPR-Cas Systems for Mammalian Genome Editing Via Proximal CRISPR Targeting," Nat. Commun. 8:14958 (2017).

Hinz, J. M., et al., "Nucleosomes Selectively Inhibit Cas9 Off-Target Activity at a Site Located at the Nucleosome Edge," J. Biol. Chem. 291(48):24851-24856 (2016).

Ran, F. A., et al., "In Vivo Genome Editing Using *Staphylococcus aureus* Cas9," Nature 520(7546):186-191 (2015).

Richardson, C. D., et al., "Enhancing Homology-Directed Genome Editing by Catalytically Active and Inactive CRISPR-Cas9 Using Asymmetric Donor DNA," Nat. Biotechnol. 34(3):339-344 (2016).

Sather, B. D., et al., "Efficient Modification of CCR5 in Primary Human Hematopoietic Cells Using a Mega TAL Nuclease and AAV Donor Template," Sci. Trans. Med. 7(307):307ra156 (2015).

Shmakov, S., et al., "Discovery and Functional Characterization of Diverse Class 2 CRISPR-Cas Systems," Mol. Cell 60(3):385-397 (2015).

Smith, C., et al., "Efficient and Allele-Specific Genome Editing of Disease Loci in Human iPSCs," Mol. Ther. 23(3):570-577 (2015).

Zetsche, B., et al., "Cpf1 Is a Single RNA-Guided Endonuclease of a Class 2 CRISPR-Cas System," Cell 163(3):759-771 (2015).

European Patent Office, International Search Report and Written Opinion dated Jun. 12, 2017 for PCT/US2017/024163.

European Patent Office, International Search Report and Written Opinion dated May 29, 2017 for PCT/US2017/022377.

U.S. Appl. No. 61/652,086, filed May 25, 2012, Jinek et al.

U.S. Appl. No. 61/716,256, filed Oct. 19, 2012, Jinek et al.

U.S. Appl. No. 61/734,256, filed Dec. 6, 2012, Chen et al.

U.S. Appl. No. 61/736,527, filed Dec. 12, 2012, Zhang et al.

U.S. Appl. No. 61/738,355, filed Dec. 17, 2012, Church et al.

U.S. Appl. No. 61/758,624, filed Jan. 30, 2013, Chen et al.

U.S. Appl. No. 61/761,046, filed Feb. 5, 2013, Knight et al.

U.S. Appl. No. 61/779,169, filed Mar. 13, 2013, Mali et al.

Adato, A., et al., "Usherin, the Defective Protein Usher Syndrome Type IIA,is Likely to be a Component of Interstereocilia Ankle Links in the Inner Ear Sensory Cells," Hum. Mol. Genet. 14(24):3921-3932 (2005).

Al-Attar, S., et al., "Clustered Regularly Interspaced Short Palindromic Repeats (CRISPRs): The Hallmark of an Ingenious Antiviral Defense Mechanism in Prokaryotes," Biol. Chem. 392:277-289 (2011).

Aller, E., et al., "The USH2A c.2299delG Mutation: Dating Its Common Origin in a Southern European Population," Eur. J. Hum. Genet. 18(7):788-793 (2010).

Altschul, S. F. et al., "Gapped BLAST and PSI-BLAST: A New Generation of Protein Database Search Programs," Nucleic Acids Res. 25(17):3389-3402 (1997).

Altschul, S. F. et al., "Basic Local Alignment Search Tool," J. Mol. Biol. 215(3):403-410 (1990).

(56) References Cited

OTHER PUBLICATIONS

Ambati, J., et al., "Diffusion of High Molecular Weight Compounds Through Sclera," Invest. Ophthalmol. Vis. Sci. 41(5):1181-1185 (2000).
Ambati, J., et al., "Transscleral Delivery of Bioactive Protein to the Choroid and Retina," Invest. Ophthalmol. Vis. Sci. 41(5):1186-1191 (2000).
Anders, C., et al., "Structural Basis of PAM-Dependent Target DNA Recognition by the Cas9 Endonuclease," Nature 513(7519):569-573 (2014).
Andreas, S., et al., "Enhanced Efficiency Through Nuclear Localization Signal Fusion on Phage PhiC31-Integrase: Activity Comparison with Cre and FLPe Recombinase in Mammalian Cells," Nucleic Acids Res. 30(11):2299-2306 (2002).
Anonymous, Third Party Observation for EP13818570.7, Oct. 1, 2014, 15 pages.
Anonymous, Third Party Observation for EP13824232.6, Sep. 8, 2014, 48 pages.
Anonymous, Third Party Observation for EP13824232.6, Sep. 22, 2014, 19 pages.
Anonymous, Third Party Observation for EP13824232.6, Oct. 22, 2014, 7 pages.
Bae, S., et al., "Cas-OFFinder: A Fast and Versatile Algorithm that Searches for Potential Off-Target Sites of Cas9 RNA-Guided Endonucleases," Bioinformatics 30(10):1473-1475 (2014).
Baker, M., "Gene Editing at CRISPR Speed," Nat. Biotechnol. 32(4):309-312 (2014).
Barker, C. S., et al., "Increased DNA Microarray Hybridization Specificity Using sscDNA Targets," BMC Genomics 6:57 (2005).
Baron-Benhamou, J., et al., "Using the LambdaN Peptide to Tether Proteins to RNAs," Methods Mol. Biol. 257:135-153 (2004).
Barrangou, R., "RNA-Mediated Programmable DNA Cleavage," Nat. Biotechnol. 30(9):836-838 (2012).
Barretina, J., et al., "The Cancer Cell Line Encyclopedia Enables Predictive Modeling of Anticancer Drug Sensitivity," Nature 483(7391):603-607 (2012).
Bassett, A. R., et al., "CRISPR/Cas9 and Genome Editing in *Drosophila*," J. Genet. Genom. 41:7-19 (2014).
Beerli, R. R., et al., "Toward Controlling Gene Expresion at Will: Specific Regulation of the erbB-2/HER-2 Promoter by Using Polydactyl Zinc Finger Proteins Constructed from Modular Building Blocks," Proc. Natl. Acad. Sci. 95:14628-14633 (1998).
Bhaya, D., et al., "CRISPR-Cas Systems in Bacteria and Archaea: Versatile Small RNAs for Adaptive Defense and Regulation," Annu. Rev. Genet. 45:273-297 (2011).
Bikard, D., et al., "Programmable Repression and Activation of Bacterial Gene Expression Using an Engineered CRISPR-Cas System," Nucl. Acids Res. 41(15):7429-7437 (2013).
Bitinaite, J., et al., "FokI Dimerization is Required for DNA Cleavage," Proc. Natl. Acad. Sci. 95:10570-10575 (1998).
Boch, J., et al., "Breaking the Code of DNA Binding Specificity of TAL-Type III Effectors," Science 326(5959):1509-1512 (2009).
Boch, J., et al., "Xanthomonas AvrBs3 Family-Type III Effectors: Discovery and Function," Annu. Rev. Phytopathol. 48:419-436 (2010).
Bonnet, C., et al., "Usher Syndrome (Sensorineural Deafness and Retinitis Pigmentosa): Pathogenesis, Molecular Diagnosis and Therapeutic Approaches," Curr. Opin. Neurol. 25(1):42-49 (2012).
Briner, A.E., et al., "Guide RNA Functional Modules Direct Cas9 Activity and Orthogonality," Mol. Cell 56(2):333-339 (2014).
Broad Institute, Communication Forwarding Declaration of Feng Zhang for U.S. Appl. No. 14/256,912, filed Nov. 24, 2014, 5 pages.
Broad Institute, Information Disclosure Statement submitted for U.S. Appl. No.. 14/256,912, citing Electronic Mail from T. Kowalski which references Briner et al., Nov. 3, 2014, 8 pages.
Broad Institute, Request for Oral Examination for EP13818570.7, dated Oct. 27, 2014, 3 pages.
Broad Institute, Response to EP Examination Report for EP13824232.6, dated Dec. 31, 2014, 44 pages.
Broad Institute, Response to Third Party Observations and Request for Oral Hearing for EP13824232.6, Oct. 27, 2014, 9 pages.
Broad Institute, Response to Third Party Observations, with redlined and clean amended claims, for EP13818570.7, Oct. 16, 2014, 30 pages.
Broad Institute, Response to Third Party Observations, with redlined and clean amended claims, for EP13824232.6, Oct. 2, 2014, 16 pages.
Brummelkamp, T. R., et al., "A System for Stable Expression of Short Interfering RNAs in Mammalian Cells," Science 296(5567):550-553 (2002).
Caldecott, K.W., "Single-Strand Break Repair and Genetic Disease," Nat. Rev. Genet. 9(8):619-631 (2008).
Canver, M. C., "Evaluation of the Clinical Success of Ex Vivo and In Vivo Gene Therapy," Journal of Young Investitgators, http://www.hyi.org/issue/evaluation-of-the-clinical-success-of-ex-vivo-and-in-vivo-gene-therapy/, 9 pages (2009).
Carroll, D., "A CRISPR Approach to Gene Targeting," Mol. Ther. 20(9):1658-1660 (2012).
Cathomen, T., et al., "Zinc-Finger Nucleases: The Next Generation Emerges," Mol. Ther. 16:1200-1207 (2008).
Cermak, T., et al., "Efficient Design and Assembly of Custom TALEN and Other TAL Effector-Based Constructs for DNA Targeting," Nucl. Acids Res. 39(12):e82 (2011).
Chen, X., et al., "Fusion Protein Linkers: Property, Design and Functionality," Adv. Drug Deliv. Rev. 65(10):1357-1369 (2013).
Cho, S. W., et al., Supplementary Information: Targeted Genome Engineering in Human Cells With the Cas9 RNA-Guided Endonuclease, Nature Biotechnology (Mar. 2013) vol. 31, No. 3, 11 pages.
Cho, S. W., et al., "Targeted Genome Engineering in Human Cells with the Cas9 RNA-Guided Endonuclease," Nat. Biotechnol. 31(3):230-232 (2013).
Christian, M., et al., "Targeting DNA Double-Strand Breaks With TAL Effector Nucleases," Genetics 186:757-761 (2010).
Christian, M., et al., "Targeting DNA Double-Strand Breaks With TAL Effector Nucleases," Genetics Supporting Information, 1SI-8SI (2010).
Chylinski, K., et al., "The TrackRNA and Cas9 Families of Type II CRISPR-Cas Immunity Systems," RNA Biol. 10(5):726-737 (2013).
Cideciyan, A.V., et al., "Human Gene Therapy for RPE65 Isomerase Deficiency Activates the Retinoid Cycle of Vision but with Slow Rod Kinetics," Proc. Natl. Acad. Sci. U.S.A. 105(39):15112-15117 (2008).
Cong, L., et al., "Multiplex Genome Engineering Using CRISPR/Cas Systems," Science 339(6121):819-823 (2013).
Cong, L. et al., "Supplementary Material: Multiplex Genome Engineering Using CRISPR-Cas Systems," Science Express (Jul. 5, 2012).
Cong, L. et al., "Supplementary Material: Multiplex Genome Engineering Using CRISPR-Cas Systems," Science Express (Jan. 3, 2013).
Cornish-Bowden, A., "Nomenclature for Incompletely Specified Bases in Nucleic Acid Sequences: Recommendations 1984," Nucleic Acids Res. 13(9):3021-3030 (1985).
Cradick, T. J., et al., "CRISPR/Cas9 Systems Targeting Beta-Globin and CCR5 Genes Have Substantial Off-Target Activity," Nucleic Acids Res. 41(20):9584-9592 (2013).
Datsenko, K. A., et al., "Molecular Memory of Prior Infections Activates the CRISPR/Cas Adaptive Bacterial Immunity System," Nat. Commun. 3:945 (2012).
Davis, L., et al., "Homology-Directed Repair of DNA Nicks Via Pathways Distinct from Canonical Double-Strand Break Repair," PNAS 111(10):E924-932 (2014).
Deltcheva, E., et al., CRISPR RNA Maturation by Trans-Encoded Small RNA and Host Factor RNase III, Nature 471:602-607 (2011).
Deltcheva, E., et al., Supplementary Figures: CRISPR RNA Maturation by Trans-Encoded Small RNA and Host Factor RNase III. Downloaded from www.nature.com/nature, p. 1-35, 2011.
Den Hollander, A.I., et al., "Lighting a Candle in the Dark: Advances in Genetics and Gene Therapy of Recessive Retinal Dystrophies," J. Clin. Invest. 120(9):3042-3053 (2010).

(56) References Cited

OTHER PUBLICATIONS

Deveau, H., et al., "Phage Response to CRISPR-Encoded Resistance in *Streptococcus thermophilus*," J. Bacteriol. 190(4):1390-1400 (2008).

Dicarlo, J. E., et al., "Genome Engineering in *Saccharomyces cerevisiae* Using CRISPR-Cas Systems," Nucl. Acids Res. 41(7):4336-43 (2013).

Dingwall, C., et al., "A Polypeptide Domain That Specifies Migration of Nucleoplasmin Into the Nucleus," Cell 30:449-458 (1982).

Dreszer, T. R., et al., "The UCSC Genome Browser Database: Extensions and Updates 2011," Nucl. Acids Res. 40:D918-D923 (2012).

Esvelt, K.M., et al., "A System for the Continuous Directed Evolution of Biomolecules," Nature 472(7344):499-503 (2011).

Esvelt, K. M., et al., "Orthogonal Cas9 Proteins for RNA-Guided Gene Regulation and Editing," Nat. Methods 10(11):1116-1121 (2013).

Eudy, J. D., et al., "Mutation of a Gene Encoding a Protein with Extracellular Matrix Motifs in Usher Syndrome Type IIa," Science 280(5370):1753-1757 (1998).

Fine, E.J., et al., "Trans-Spliced Cas9 Allows Cleavage of HBB and CCR5 Genes in Human Cells Using Compact Expression Cassettes," Sci. Rep. 5:10777 (2015).

Fonfara, I., et al., "Phylogeny of Cas9 Determines Functional Exchangeability of Dual-RNA and Cas9 Among Orthologous Type II CRISPR-Cas Systems," Nucl. Acids Res.42(4):2577-2590 (2014).

Friedland, A.E., et al., "Characterization of *Staphylococcus aureus* Cas9: A Smaller Cas9 for All-in-One Adeno-Associated Virus Delivery and Paired Nickase Applications," Genome Biol. 16:257 (2015).

Frit, P., et al., "Alternative End-Joining Pathway(s): Bricolage at DNA Breaks," DNA Repair (Amst) 17:81-97 (2014).

Fu, Y., et al., "High-Frequency Off-Target Mutagenesis Induced by CRISPR-Cas Nucleases in Human Cells," Nat. Biotechnol. 31:822-826 (2013).

Fu, Y., et al., "Improving CRISPR-Cas Nuclease Specificity Using Truncated Guide RNAs," Nat. Biotechnol. 32(3):279-284 (2014).

Gabriel, R., et al., "An Unbiased Genome-Wide Analysis of Zinc-Finger Nuclease Specificity," Nat. Biotechnol. 29:816-823 (2011).

Garanto, A., et al., "Unexpected CEP290 mRNA Splicing in a Humanized Knock-In Mouse Model for Leber Congenital Amaurosis," PLoS One 8(11):e79369 (2013).

Garneau, J. E., et al., "The CRISPR-Cas Bacterial Immune Systems Cleaves Bacteriophage and Plasmid DNA," Nature 468:67-71 (2010).

Gasiunas, G., et al., "Cas9-crRNA Ribonucleoprotein Complex Mediates Specific DNA Cleavage for Adaptive Immunity in Bacteria," Proc. Natl. Acad. Sci. 109(39):E2579-E2586 (2012).

Gilbert, L. A., et al., "CRISPR-Mediated Modular RNA-Guided Regulation of Transcription in Eukaryotes," Cell 154(2):442-451 (2013).

Goldfarb, D. S., et al., "Synthetic Peptides as Nuclear Localization Signals," Nature 322:641-644 (1986).

Gratz, S. J., et al., "Genome Engineering of *Drosophila* with the CRISPR RNA-Guided Cas9 Nuclease," Genetics 194(4):1029-1035 (2013).

Grieger, J. C., et al., "Production and Characterization of Adeno-Associated Viral Vectors," Nat. Protoc. 1(3):1412-1428 (2006).

Guilinger, J. P., et al., "Fusion of Catalytically Inactive Cas9 to FokI Nuclease Improves the Specificity of Genome Modification," Nat Biotechnol. 32(6):577-583 (2014).

Guo, X., et al., "RNA-Dependent Folding and Stabilization of C5 Protein During Assembly of the *E. coli* Rnase P Holoenzyme," J. Mol. Biol. 360:190-203 (2006).

Gustafsson, C., et al., "Codon Bias and Heterologous Protein Expression," Trends Biotechnol. 22(7):346-353 (2004).

Haft, D. H., et al., "A Guild of 45 CRISPR-Associated (Cas) Protein Families and Multiple CRISPR/Cas Subtypes Exist in Prokaryotic Genomes," PLoS Comput. Biol. 1(6):e60 (2005).

Hale, C. R., et al., "Essential Features and Rational Design of CRISPR RNAs That Function With the Cas RAMP Module Complex to Cleave RNAs," Mol. Cell 45(3):292-302 (2012).

Hatoum-Aslan, A., et al. "Mature Clustered Regularly Interspaced, Short Palindromic Repeats RNA 5,9,14 (crRNA) Length is Measured by a Ruler Mechanism Anchored at the Precursor Processing Site," Proc. Natl. Acad. Sci. 108(52):21218-21222 (2011).

Heigwer, F., et al., "E-CRISP: Fast CRISPR Target Site Identification," Nat. Methods 11(2):122-123 (2014).

Hockemeyer, D., et al., "Efficient Targeting of Expressed and Silent Genes in Human ESCs and iPSCs Using Zinc-Finger Nucleases," Nat. Biotechnol. 27(9):851-857 (2009).

Hockemeyer, D., et al., "Genetic Engineering of Human luripotent Cells Using TALE Nucleases," Nat. Biotechnol. 29:731-734 (2011).

Holt, N, et al., "Zinc Finger Nuclease-Mediated CCR5 Konockout Hematopoietic Stem Cell Transplantation Controls HIV-1 In Vivo," Nat. Biotechnol. 28(8):839-847 (2010).

Horvath, P., et al., "CRISPR/Cas, The Immune System of Bacteria and Archaea," Science 327(5962):167-170 (2010).

Horvath, P., et al., "RNA-Guided Genome Editing A La Carte," Cell Res. 23:733-734 (2013).

Hou, Z., et al., "Efficient Genome Engineering in Human Pluripotent Stem Cells Using Cas9 from Neisseria Meningitidis," Proc. Natl. Acad. Sci. U.S.A. 110(39):15644-15649 (2013).

Hsu, P.D., et al., "DNA Targeting Specificity of RNA-Guided Cas9 Nucleases," Nat. Biotechnol. 31(9):827-832 (2013).

Hwang, W. Y., et al., "Heritable and Precise Zebrafish Genome Editing Using a CRISPR-Cas System," PLoS One 8(7):e68708 (2013).

Hwang, W. Y., et al., "Efficient Genome Editing in Zebrafish Using a CRISPR-Cas System," Nat. Biotechnol. 31(3):227-229 (2013).

Iyama, T., et al., "DNA Repair Mechanisms in Dividing and Non-Dividing Cells," DNA Repair (Amst.) 12(8):620-636 (2013).

Iyer, L. M., et al., "Prediction of Novel Families of Enzymes Involved in Oxidative and Other Complex Modifications of Bases in Nucleic Acids," Cell Cycle 8(11):1698-1710 (2009).

Jiang, W., et al., "RNA-Guided Editing of Bacterial Genomes Using CRISPR-Cas Systems," Nat. Biotechnol. 31(3):233-239 (2013).

Jinek, M., et al., "A Programmable Dual-RNA-Guided DNA Endonuclease in Adaptive Bacterial Immunity," Science 337(6096):816-821 (2012).

Jinek, M., et al., "Structures of Cas9 Endonucleases Reveal RNA-Mediated Conformational Activation," Science 343(6176):1247997 (2014).

Jinek, M., et al., "RNA-Programmed Genome Editing in Human Cells," eLife 2:e00471 (2013).

Kaiser, J., "The Gene Editor CRISPR Won't Fully Fix Sick People Anytime Soon. Here's Why," (May 3, 2016), Biol., Technol, CRISPR, DOI: 10.1126/science.aaf5689, 5 pages.

Karolchik, D., et al., "The UCSC Table Browser Data Retrieval Tool," Nucleic Acids Research 32:D493-496 (2004).

Kent, W. J., et al., "The Human Genome Browser at UCSC," Genome Research 12:996-1006 (2002).

Keryer-Bibens, C., et al., "Tethering of Proteins to RNAs by Bacteriophage Proteins," Biol. Cell, 100:125-138 (2008).

Khalil, A. S., et al., "Synthetic Biology: Applications Come of Age," Nat. Rev. Genet. 11(5):367-379 (2010).

Kim, Y.G., et al., "Hybrid Restriction Enzymes: Zinc Finger Fusions to Fok I Cleavage Domain," Proc. Natl. Acad. Sci. USA 93:1156-1160 (1996).

Kimberling, W. J., et al., "Frequency of Usher Syndrome in Two Pediatric Populations: Implications for Genetic Screening of Deaf and Hard of Hearing Children," Genet. Med. 12(8):512-516 (2010).

King, N. M.P., et al., "En Route to Ethical Recommendations for Gene Transfer Clinical Trials," Mol. Ther. 16(3):432-438 (2008).

Kleinstiver, B.P., et al., "Broadening the Targeting Range of *Staphylococcus aureus* CRISPR-Cas9 by Modifying PAM Recognition," Nat. Biotechnol. 33(12):1293-1298 (2015).

Kleinstiver, B.P., et al., "Engineered CRISPR-Cas9 Nucleases with Altered PAM Specificities," Nature 523(7561):481-485 (2015).

Kleinstiver, B.P., et al., "High-Fidelity CRISPR-Cas9 Nucleases with No Detectable Genome-Wide Off-Target Effects," Nature 529(7587):490-495 (2016).

(56) References Cited

OTHER PUBLICATIONS

Koenekoop, R.K., et al., "Genetic Testing for Retinal Dystrophies and Dysfunctions: Benefits, Dilemmas and Solutions," Clin. Exp. Ophthalmol. 35(5):473-485 (2007).
Komor, A.C., et al., "Programmable Editing of a Target Base in Genomic DNA Without Double-Stranded DNA Cleavage," Nature 533(7603):420-424 (2016).
Kosuri, S., et al., "A Scalable Gene Synthesis Platform Using High-Fidelity DNA Microchips," Nat. Biotechnol. 28(12):1295-1299 (2010).
Lambowitz, a. M., et al., "Group II Introns: Mobile Ribozymes that Invade DNA," Cold Spring Harb. Perspect. Biol. 3:a003616 (2011).
Langmead, B., et al., "Ultrafast and Memory-Efficient Alignment of Short DNA Sequences to the Human Genome," Genome Biology 10(3):R25 (2009).
Le Quesne Stabej, P., et al., "Comprehensive Sequence Analysis of Nine Usher Syndrome Genes in the UK National Collaborative Usher Study," J. Med. Genet. 49(1):27-36 (2012).
Leber, T., "On Retinitis Pigmentosa and Congenital Amaurosis," Archiv fur Ophthalmologie 15(3):1-25 (1869).
Lee, J.H., et al., "A Robust Approach to Identifying Tissue-Specific Gene Expression Regulatory Variants Using Personalized Human Induced Pluripotent Stem Cells," PLoS Genetics 5(11):e1000718 (2009).
Lee, J., et al., "Non-Endocytic Delivery of Functional Engineered Nanoparticles into the Cytoplasm of Live Cells Using a Novel, High-Throughput Microfluidic Device," Nano Lett. 12(12):6322-6327 (2012).
Li, G.M., "Mechanisms and Functions of DNA Mismatch Repair," Cell Res. 18(1):85-98 (2008).
Li, T., et al., "TAL Nucleases (TALNs): Hybrid Proteins Composed of TAL Effectors and FokI DNA-Cleavage Domain," Nucl. Acids Res.39(1): 359-372 (2011).
Li, H., et al., "In Vivo Genome Editing Restores Hemostasis in a Mouse Model of Hemophilia," Nature 475(7355):217-221 (2011).
Li, T., et al., "Modularly Assembled Designer TAL Effector Nucleases for Targeted Gene Knockout and Gene Replacement in Eukaryotes," Nucl. Acids Res. 39(14):6315-6325 (2011).
Lombardo, A., et al., "Gene Editing in Human Stem Cells Using Xinc Finger Nucleases and Integrase-Defective Lentiviral Vector Delivery," Nat. Biotechnol. 25(11):1298-1306 (2007).
Lorenz, R., et al., "ViennaRNA Package 2.0," Algorithms for Molecular Biology 6:26 (2011).
Maeder, M. L., et al., "CRISPR RNA-Guided Activation of Endogenous Human Genes," Nat. Methods 10:977-979 (2013).
Maeder, M. L., et al., "Rapid "Open-Source" Engineering of Customized Zinc-Finger Nucleases for Highly Efficient Gene Modification," Mol. Cell 31(2):294-301 (2008).
Makarova, K. S., et al., "A Putative RNA-Interference-Based Immune System in Prokaryotes: Computational Analysis of the Predicted Enzymatic Machinery, Functional Analogies with Eukaryotic RNAi, and Hypothetical Mechanisms of Action," Biol. Direct. 1:7 (2006).
Makarova, K. S., et al., "Unification of Cas Protein Families and a Simple Scenario for the Origin and Evolution of CRISPR-Cas Systems," Biol. Direct 6:38 (2011).
Makarova, K.S., et al., "Evolution and Classification of the CRISPR-Cas Systems," Nat. Rev. Microbiol. 9(6):467-477 (2011).
Mali, P., et al., "CAS9 Transcriptional Activators for Target Specificity Screening and Paired Nickases for Cooperative Genome Engineering," Nat. Biotechnol. 31:833-838 (2013).
Mali, P., et al., "Cas9 as a Versatile Tool for Engineering Biology," Nat. Methods 10(10):957-963 (2013).
Mali, P., et al., "RNA-Guided Human Genome Engineering Via Cas9," Science 339(6121):823-826 (2013).
Marteijn, J.A., et al., "Understanding Nucleotide Excision Repair and Its Role in Cancer and Ageing," Nat. Rev. Mol. Cell Biol. 15(7):465-481 (2014).
Mathews, D. H., et al., "Expanded Sequence Dependence of Thermodynamic Parameters Improves Prediction of RNA Secondary Structure," J. Mol. Biol. 288:911-940 (1999).

Miller, J. C., et al., "An Improved Zinc-Finger Nuclease Architecture for Highly Specific Genome Editing," Nat. Biotechnol. 25:778-785 (2007).
Miller, J. C., et al., "A TALE Nuclease Architecture for Efficient Genome Editing," Nat. Biotechnol. 29(2):143-150 (2011).
Miyagishim M., et al., "U6 Promoter-Driven siRNAs with Four Uridine 3' Overhangs Efficiently Suppress Targeted Gene Expression in Mammalian Cells," Nat. Biotechnol. 20(5):497-500 (2002).
Moscou, M. J., et al., "A Simple Cipher Governs DNA Recognition by TAL Effectors," Science 326(5959):1501 (2009).
Myers, E. W., et al., "Optimal Alignments in Linear Space," Comput. Appl. Biosci. 4(1):11-17 (1988).
Nakamura, Y., et al., "Codon Usage Tabulated From International DNA Sequence Databases: Status for the Year 2000," Nucl. Acids Res. 28(1):292 (2000).
Needleman, S. B., et al., "A General Method Applicable to the Search for Similarities in the Amino Acid Sequence of Two Proteins," J. Mol. Biol. 48(3):443-453 (1970).
Nishimasu, H., et al., "Crystal Structure of Cas9 in Complex with Guide RNA and Target DNA," Cell 156(5):935-949 (2014).
Nishimasu, H., et al., "Crystal Structure of *Staphylococcus aureus* Cas9," Cell 162:1113-1126 (2015).
Pattanayak, V., et al., "High-Throughput Profiling of Off-Target DNA Cleavage Reveals RNA-Programmed Cas9 Nuclease Specificity," Nat. Biotechnol. 31:839-843 (2013).
Pattanayak, V., et al., "Revealing Off-Target Cleavage Specificities of Zinc-Finger Nucleases by In Vitro Selection," Nat. Methods 8:765-770 (2011).
Patterson, S. S., et al., "Codon Optimization of Bacterial Luciferase (lux) for Expression in Mammalian Cells," J. Ind. Microbio. Biotechnology 32:115-123 (2005).
Pearson, W. R., et al., "Improved Tools for Biological Sequence Comparison," Proc. Natl. Acad. Sci. U.S.A. 85(8):2444-2448 (1988).
Perez, E. E., et al., "Establishment of HIV-1 Resistance in CD4+ T Cells by Genome Editing Using Zinc-Finger Nucleases," Nat. Biotechnol. 26:808-816 (2008).
Porteus, M. H., et al., "Gene Targeting Using Zinc Finger Nucleases," Nat. Biotechnol. 23(8):967-973 (2005).
Pougach, K., et al., "Transcription, Processing and Function of CRISPR Cassettes in *Escherichia coli*," Mol. Microbiol. 77(6):1367-1379 (2010).
Pride, D. T., et al., "Analysis of Streptococcal CRISPRs from Human Saliva Reveals Substantial Sequence Diversity Within and Between Subjects Over Time," Genome Res. 21:126-136 (2011).
Purnick, P. E. M., et al., "The Second Wave of Synthetic Biology: From Modules to Systems," Nat. Rev. Mol. Cell Biol. 10(6):410-422 (2009).
Qi, L. S., et al., "Repurposing CRISPR as an RNA-Guided Platform for Sequence-Specific Control of Gene Expression," Cell 152:1173-1183 (2013).
Qi, L., et al., "RNA Processing Enables Predictable Programming of Gene Expression," Nat. Biotechnol. 30(10):1002-1007 (2012).
Quinlan, a. R., et al., "BEDTools: A Flexible Suite of Utilities for Comparing Genomic Features," Bioinformatics 26(6):841-842 (2010).
Ran, F.A., et al., "Double Nicking by RNA-Guided CRISPR Cas9 for Enhanced Genome Editing Specificity," Cell 154(6):1380-1389 (2013).
Rand, T. A., et al., "Argonaute2 Cleaves the Anti-Guide Strand of siRNA During RISC Activation," Cell 123:621-629 (2005).
Rao, R. C., et al., "Cell and Gene Therapy," Dev. Ophthalmol. 53:167-177 (2014).
Raymond, C. S., et al., "High-Efficiency FLP and PhiC31 Site-Specific Recombination in Mammalian Cells," PLoS One 2(1):e162 (2007).
Rebar, E. J., et al., "Zinc Finger Phage: Affinity Selection of Fingers with New DNA-Binding Specificities," Science 263(5147):671-673 (1994).
Rebar, E. J., et al., "Induction of Angiogenesis in a Mouse Model Using Engineered Transcription Factors," Nat. Med. 8(12):1427-1432 (2008).
Recht, M. I., et al., "Monitoring Assembly of Ribonucleoprotein Complexes by Isothermal Titration Calorimetry," Methods in Mol. Biol. 488:117-127 (2008).

(56) References Cited

OTHER PUBLICATIONS

Regalado, A., "Who Owns the Biggest Biotech Discovery of the Century?," MIT Technology Review, Dec. 4, 2014, http://www.technologyreview.com/featuredstory/532796/who-owns-the-biggest--biotech-discovery-of-the-century/.
Reyon, D., et al., "FLASH Assembly of TALENs for High-Throughput Genome Editing," Nat. Biotech. 30:460-465 (2012).
Rho, M., et al. "Diverse CRISPRs Evolving in Human Microbiomes." PLoS Genetics 8(6):e1002441 (2012).
Sander, J. D., et al., "Zinc Finger Targeter (ZiFiT): An Engineered Zinc Finger/Target Site Design Tool," Nucleic Acids Res. 35:W599-W605 (2007).
Sander, J. D., et al., "ZiFiT (Zinc Finger Targeter): An Updated Zinc Finger Engineering Tool," Nucleic Acids Res. 38:W462-468 (2010).
Sander, J. D., et al., "CRISPR-Cas Systems for Editing, Regulating and Targeting Genomes," Nat. Biotechnol. 32(4):347-355 (2014).
Sanders, R., "Cheap and Easy Technique to Snip DNA Could Revolutionize Gene Therapy", Berkeley News Online, pp. 1-3 (Jan. 7, 2013).
Sanjana, N. E., et al., "A Transcription Activator-Like Effector (TALE) Toolbox for Genome Engineering," Nat. Protoc. 7(1):171-192 (2012).
Sapranauskas, R., et al., "The *Streptococcus thermophilus* CRISPR-Cas System Provides Immunity in *Escherichia coli*," Nucl. Acids Res.39:9275-9282 (2011).
Schramm, L., et al., "Recruitment of RNA Polymerase III to Its Target Promoters," Genes Devel. 16:2593-2620 (2002).
Selleck, W., et al., "Biophysical Characterization and Direct Delivery of *S. pyogenes* Cas9 Ribonucleoprotein Complexes," Editas Medicine, Apr. 27, 2015, retrieved from URL http://www.editasmedicine.com/documents/ASGCT_poster_2015_Will.pdf.
Shanks, P., "CRISPR Opportunities . . . For What? And for Whom?," Biopolitical Times, Dec. 4, 2014, http://www.biopoliticaltimes.org/article.php?id=8235.
Sharma, R., et al., "In Vivo Genome Editing of the Albumin Locus as a Platform for Protein Replacement Therapy," Blood 126(15):1777-1784 (2015).
Shayakhmetov, D. M., et al., "Analysis of Adenovirus Sequestration in the Liver, Transduction of Hepatic Cells, and Innate Toxicity after Injection of Fiber-Modified Vectors," J. Virol. 78(10):5368-5381 (2004).
Shen, B., et al., "Generation of Gene-Modified Mice via Cas9/RNA-Mediated Gene Targeting," Cell Res. 23:720-723 (2013).
Smith, T. F., et al., "Comparison of Biosequences," Adv. Appl. Math. 2(4):482-489 (1981).
Sontheimer, E., "Project 7: Establishing RNA-Directed DNA Targeting in Eukaryotic Cells; Project dates: Nov. 16, 2011 to Dec. 31, 2012," Physical Sciences—Oncology Center (Feb. 4, 2012).
Sternberg, S.H., et al., "DNA Interrogation by the CRISPR RNA-Guided Endonuclease Cas9," Nature 507(7490):62-67 (2014).
Sugimoto, N., et al., "Thermodynamic Parameters to Predict Stability of RNA/DNA Hybrid Duplexes," Biochem. 34:11211-11216 (1995).
Sugimoto, N., et al., "Thermodynamics-Structure Relationship of Single Mismatches in RNA/DNA Duplexes," Biochem. 39(37):11270-11281 (2000).
Szczepek, M., et al., "Structure-Based Redesign of the Dimerization Interface Reduces the Toxicity of Zinc-Finger Nucleases," Nat. Biotechnol. 25:786-793 (2007).
Terns, M. P., et al., "CRISPR-based Adaptive Immune Systems," Curr. Opin. Microbiol. 14:321-327 (2011).
Thurman, R. E., et al., "The Accessible Chromatin Landscape of the Human Genome," Nature 489(7414):75-82 (2012).
Tolia, N. H., et al., "Slicer and the Argonautes," Nat. Chem. Biol. 3(1):36-43 (2007).
Tolpin, Thomas W., Third Party Observation for EP13793997.1, Jan. 6, 2015, 50 pages.
Tsai, S. Q., et al., "Dimeric CRISPR RNA-Guided FokI Nucleases for Highly Specific Genome Editing," Nat. Biotechnol. 32(6):569-576 (2014).
Tsai, S.Q., et al., "Open-Source GuideSeq Software for Analysis of GUIDE-Seq Data," Nat. Biotechnol. 34(5):483 (2016).
Urnov, F. D., et al., "Highly Efficient Endogenous Human Gene Correction Using Designed Zinc-Finger Nucleases," Nature 435:646-651 (2005).
Vache, C., et al., "Usher Syndrome Type 2 Caused by Activation of an USH2A Pseudoexon: Implications for Diagnosis and Therapy," Hum. Mutat. 33(1):104-108 (2012).
Van Der Oost, J., "New Tool for Genome Surgery," Science 336:768-768 (2013).
Van Der Ploeg, J. R., "Analysis of CRISPR in *Streptococcus mutans* Suggests Frequent Occurrence of Acquired Immunity Against Infection by M102-Like Bacteriophages," Microbiology 155:1966-1976 (2009).
Wang, H., et al., "One-Step Generation of Mice Carrying Mutations in Multiple Genes by CRISPR/Cas-Mediated Genome Engineering," Cell 153(4):910-918 (2013).
Wang, J., et al., "Homology-Driven Genome Editing in Hematopoietic Stem and Progenitor Cells Using ZFN mRNA and AAV6 Donors," Nat. Biotechnol. 33(12):1256-1263 (2015).
Wang, J., et al., "Highly Efficient Homology-Driven Genome Editing in Human T Cells by Combining Zinc-Finger Nuclease mRNA and AAV6 Donor Delivery," Nucleic Acids Res. 44(3):e30 (2016).
Wang, T., et al., "Genetic Screens in Human Cells Using the CRISPR-Cas9 System," Science 343(6166):80-84 (2013).
Weston, M. D., et al., "Genomic Structure and Identification of Novel Mutations in Usherin, the Gene Responsible for Usher Syndrome Type IIa," Am. J. Hum. Genet. 66(4):1199-1210 (2000).
Wiedenheft, B., et al., "RNA-Guided Genetic Silencing Systems in Bacteria and Archaea," Nature 482:331-338 (2012).
Wu, X., et al., "Genome-Wide Binding of the CRISPR Endonuclease Cas9 in Mammalian Cells," Nat. Biotechnol. 32(7):670-676 (2014).
Wu, Y., et al., "Correction of a Genetic Disease in Mouse via Use of CRISPR-Cas9," Cell Stem Cell 13(6):659-662 (2013).
Xiao, A., et al., "CasOT: A Genome-Wide Cas9/gRNA Off-Target Searching Tool," Bioinformatics 30(8):1180-1182 (2014).
Xu, Q., et al., "Design of 240,000 Orthogonal 25mer DNA Barcode Probes," Proc. Natl. Acad. Sci.106(7):2289-2294 (2009).
Yan, D., et al., "Mutation Analysis in the Long Isoform of USH2A in American Patients with Usher Syndrome Type II," J. Hum. Genet. 54(12):732-738 (2009).
Yang, H., et al., "One-Step Generation of Mice Carrying Reporter and Conditional Alleles by CRISPR/Cas-Mediated Genome Engineering," Cell 154(6):1370-1390 (2013).
Yang, J., et al., Current Understanding of Usher Syndrome Type II, Front. Biosci. (Landmark Ed.) 17:1165-1183 (2012).
Zetsche, B., et al., "A Split-Cas9 Architecture for Inducible Genome Editing and Transcription Modulation," Nat. Biotechnol. 33(2):139-142 (2015).
Zheng, A., et al., "Personalized Therapeutic Strategies for Patients with Retinitis Pigmentosa," Expert Opin. Biol. Ther. 15(3):391-402 (2015).
Zou, J., et al., "Gene Targeting of a Disease-Related Gene in Human Induced Pluripotent Stem and Embryonic Stem Cells," Cell Stem Cell 5(1):97-110 (2009).
7th Annual 2014 Midwest Eye Research Symposium Program, Aug. 8, 2014, retrieved from: http://webeye.ophth.uiowa.edu/eig/MERS_2014.html#Back.
European Patent Office, International Search Report and Written Opinion dated Jun. 24, 2015 for PCT/US2015/019064.
European Patent Office, International Search Report and Written Opinion dated Jul. 1, 2015 for PCT/US2015/019790.
European Patent Office, International Search Report and Written Opinion dated Sep. 28, 2015 for PCT/US2015/022856.
European Patent Office, International Search Report and Written Opinion dated Jul. 31, 2015 for PCT/US2015/022851.
European Patent Office, International Search Report and Written Opinion dated Aug. 10, 2015 for PCT/US2015/023906.
European Patent Office, International Search Report and Written Opinion dated Jul. 28, 2016 for PCT/US2016/029252.
European Patent Office, Examination Report for EP 13824232.6, dated Dec. 16, 2014, 4 pages.

(56) References Cited

OTHER PUBLICATIONS

United States Patent and Trademark Office, International Search Report and Written Opinion for PCT/US2013/075317, dated Apr. 15, 2014, 12 pages.
United States Patent and Trademark Office, International Search Report and Written Opinion for PCT/US2013/075326, dated Aug. 22, 2014, 13 pages.
United States Patent and Trademark Office, International Search Report and Written Opinion for PCT/US2014/027335, dated Jul. 16, 2014, 13 pages.
United States Patent and Trademark Office, International Search Report and Written Opinion for PCT/US2014/028630, dated Jul. 24, 2014, 9 pages.
United States Patent and Trademark Office, Invitation to Pay Additional Fees and, Where Applicable, Protest Fee for PCT/US2014/029068, dated Aug. 20, 2014, 3 pages.
United States Patent and Trademark Office, Office Action for U.S. Appl. No. 14/319,380, dated Jan. 28, 2015, 47 pages.
United States Patent and Trademark Office, Office Action for U.S. Appl. No. 14/319,530, dated Apr. 1, 2015, 23 pages.
Amrani, N., et al., "NmeCas9 is an Intrinsically High-Fidelity Genome-Editing Platform," Genome Biol. 19:214 (2018).
Burstein, D., et al., "New CRISPR-Cas Systems from Uncultivated Microbes," Nature 542(7640):237-241 (2017).
Cassini, A., et al., "A Highly Specific SpCas9 Variant is Identified by In Vivo Screening in Yeast," Nat. Biotechnol. 36(3):265-271 (2018).
Chen, J. S., et al., "Enhanced Proofreading Governs CRISPR-Cas9 Targeting Accuracy," Nature 550(7676):407-410 (2017).
Daiger, S. P., et al., "Perspective on Genes and Mutations Causing Retinitis Pigmentosa," Arch. Ophthalmol. 125(2):151-158 (2007).
Fu, Y., et al., "Targeted Genome Editing in Human Cells Using CRISPR/Cas Nucleases and Truncated Guide RNAs," Methods Enzymol. 546:21-45 (2014).
Jain, A., et al., "CRISPR-Cas9-Based Treatment of Myocilin-Associated Glaucoma," PNAS 114(42):11199-11204 (2017).
Karvelis, T., et al., "crRNA and tracrRNA Guide Cas9-Mediated DNA Interference in *Streptococcus thermophilus*," RNA Biol. 10(5):841-851 (2013).
Kim, H.S., et al., "Problems Encountered in Detecting a Targeted Gene by the Polymerase Chain Reaction," Gene 103:227-233 (1991).
Kim, B. J., et al., "Gene Therapy for Ocular Diseases," Genetic Diseases of the Eye, 2nd Ed., Editor Elias I. Traboulsi, MD., Published by Oxford Univ. Press, Oxford, England, 20 pages (2012).
Kim, E., et al., "In Vivo Genome Editing with a Small Cas9 Orthologue Derived from Campylobacter Jejuni," Nat. Commun. 8:14500 (2017).
Lee, J. K., et al., "Directed evolution of CRISPR-Cas9 to Increase Its Specificity," Nat. Commun. 9:3048 (2018).
Li, P., et al., "Allele-Specific CRISPR-Cas9 Genome Editing of the Single-Base P23H Mutation for Rhodopsin-Associated Dominant Retinitis Pigmentosa," CRISPR J. 1(1):55-64 (2018).
Liang, P., et al., "CRISPR/Cas9-Mediated Gene Editing in Human Tripronuclear Zygotes," Protein Cell 6(5):363-372 (2015).
Nishimasu, H., et al., "Engineered CRISPR-Cas9 Nuclease with Expanded Targeting Space," Science 361(6408):1259-1262 (2018).
Pellissier, L. P., et al., "Specific Tools for Targeting and Expression in Muller Glial Cells," Mol. Ther. Methods Clin. Dev. 1:14009 (2014).
Peng, R., et al., "Potential Pitfalls of CRISPR/Cas9-Mediated Genome Editing," FEBS J. 283:1218-1231 (2016).
Singh, M., et al., "Genes and Genetics in Eye Diseases: A Genomic Medicine Approach for Investigating Hereditary and Inflammatory Ocular Disorders," Int. J. Ophthalmol. 11(1):117-134 (2018).

Stone, E.M., et al., "Clinically Focused Molecular Investigation of 1000 Consecutive Families with Inherited Retinal Disease," Opthalmol. 124(9):1314-1331 (2017).
Strecker, J., et al., "Engineering of CRISPR-Cas12b for Human Genome Editing," Nat. Commun. 10:212 (2019).
Tang, L., et al., "CRISPR/Cas9-Mediated Gene Editing in Human Zygotes Using Cas9 Protein," Mol. Genet. Genom. 292(3):525-533 (2017).
Teng, F., et al., "Repurposing CRISPR-Cas12b for Mammalian Genome Engineering," Cell Discov. 4:63 (2018).
Truong, L. N., et al., "Microhomology-Mediated End Joining and Homologous Recombination Share the Initial End Resection Step to Repair DNA Double-Strand Breaks in Mammalian Cells," PNAS 110(19):7720-7725 (2013).
Van Overbeek, M., et al., "DNA Repair Profiling Reveals Nonrandom Outcomes at Cas9-Mediated Breaks," Mol. Cell 63:633-646 (2016).
Wang, J., et al., "xCas9 Expands the Scope of Genome Editing with Reduced Efficiency in Rice," Plant Biotechnol. J. 17:709-711 (2019).
Yamano, T., et al., "Crystal Structure of Cpf1 in Complex with Guide RNA and Target DNA," Cell 165(4):949-962 (2016).
Yan, W. X., et al., "Functionally Diversse Type V CRISPR-Cas Systems," Science 363:88-91 (2019).
Cramer, M. L., et al., "Induction of T-Cell Infiltration and Programmed Death Ligand 2 Expression by Adeno-Associated Virus in Rhesus Macaque Skeletal Muscle and Modulation by Prednisone," Hum. Gene Ther. 28(6):493-509 (2017).
Guo, Q., et al., "'Cold shock' increases the frequency of homology directed repair gene editing in induced pluripotent stem cells," Sci. Rep. 8(1):2080 (2018).
Kumar, S. R.P., et al., "Clinical development of gene therapy: results and lessons from recent successes," Mol. Ther. Methods Clin. Dev. 3:16034 (2016).
Li, W., et al., "Gene Therapy Following Subretinal AAV5 Vector Delivery Is Not Affected by a Previous Intravitreal AAV5 Vector Administration in the Partner Eye," Mol. Vision 15:267-275 (2009).
Lopes, V. S., et al., "Retinal Gene Therapy with a Large MYO7A cDNA Using Adeno-Associated Virus," Gene Ther. 20(8):824-833 (2013).
Paix, A., et al., "Precision Genome Editing Using CRISPR-Cas9 and Linear Repair Templates in C. Elegans," Methods 121-121:86-93 (2017).
Sobrevals, L., et al., "AAV Vectors Transduce Hepatocytes In Vivo as Efficiently in Cirrhotic as in Healthy Rat Livers," Gene Ther. 19:411-417 (2012).
Vandenberghe, L. H., et al., "Dosage Thresholds for AAV2 and AAV8 Photoreceptor Gene Therapy in Monkey," Sci. Transl. Med. 3(88):88ra54 (2011).
Xue, K., et al., "Technique of Retinal Gene Therapy: Delivery of Viral Vector Into the Subretinal Space," Eye 31 (9):1308-1316 (2017).
Yadav, S. P., et al., "The Transcription-Splicing Protein NonO/p54nrb and Three NonO-Interacting Proteins Bind to Distal Enhancer Region and Augment Rhodopsin Expression," Hum. Mol. Genet. 23(8):2132-2144 (2014).
Zetsche, B., et al., "Multiplex Gene Editing by CRISPR-Cpf1 Through Autonomous Processing of a Single crRNA Array," Nat. Biotechnol. 35(1):31-34 (2017).
Ding, Q., et al., "Enhanced Efficiency of Human Pluripotent Stem Cell Genme Editing through Replacing TALENs with CRIPSRs," Cell Stem Cell 12:393-394 (2013).
Heintze, J., et al., "A CRISPR CASe for High-Throughput Silencing," Front. Genet. 4(193):1-6 (2013).
Mukherjee-Clavin, B., et al., "Current Approaches for Efficient Genetic Editing in Human Pluripotent Stem Cells," Front. Biol. 8(5):461-467 (2013).

\* cited by examiner

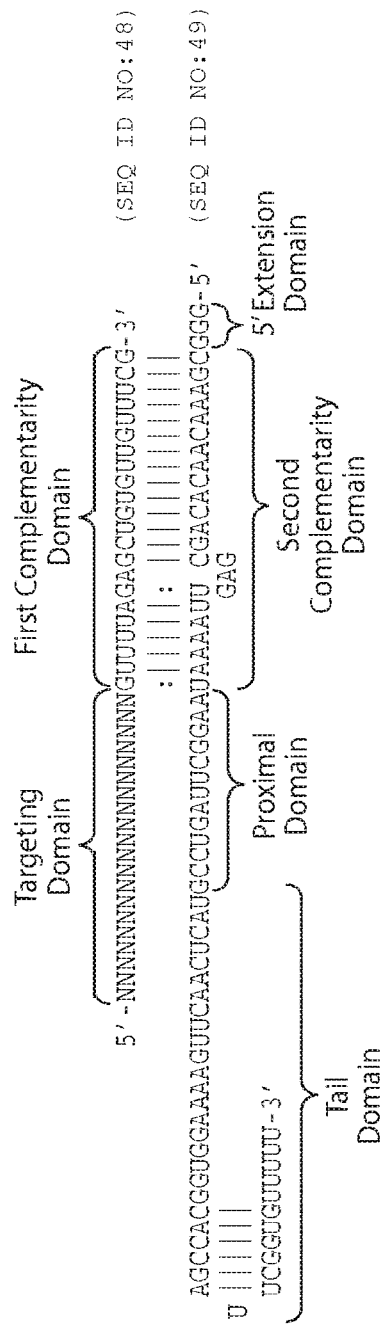

CLUSTAL format alignment by MAFFT (v7.058b)

```
SM          KKPYSIGLDIGTNSVGWAVITDDYKVPAKKMKVLGNTDKSHIEKNLLGALLFDSGNTAED
SP          DKKYSIGLDIGTNSVGWAVITDEYKVPSKKFKVLGNTDRHSIKKNLLIGALLFDSGETAEA
ST          TKPYSIGLDIGTNSVGWAVITDNYKVPSKKMKVLGNTSKKYIKKNLLGVLLFDSGITAEG
LI          KKPYTIGLDIGTNSVGWAVITDQYDLVKRKMKIAGDSEKKQIKKNFWGVRLFDEGQTAAD
            * *:****.*********.**: .:  .: . *:::: *: ****. ****:* ::**
Motif:      -K-Y*IGLDIGTNSVGWAV--TD*Y-*---*K*K*--I*KN*--G--LFD-G--TA--

SM          RRLKRTARRRYTRRRNRILYLQEIFSEEMGKVDDSFFHRLEDSFLVTEDKRGERHPIFGN
SP          TRLKRTARRRYTRRKNRICYLQEIFSNEMAKVDDSFFHRLEESFLVEEDKKHERHPIFGN
ST          RRLKRTARRRYTRRRNRILYLQEIFSTEMATLDDAFFQRLDDSFLVPDDKRDSKYPIFGN
LI          RRMARTARRRIERRRNRISYLQGIFAEEMSKTDANFFCRLSDSFYVDNEKRNSRHPFFAT
            *:  ******: **:*** ****.**.:** . .*:.**.:**:*.::*: : :* *.
Motif:      -R*-RTARRR--RR*NRI-YLQ-IF*-EM---D--FF-RL-*SF-V-**K*--**P*F--

SM          LEEEVKYHENFPTIYHLRQYLADNPEKVDLRLVYLALAHIIKFRGHFLIEGKFDTRNNDV
SP          IVDEVAYHEKYPTIYHLRKKLVDSTDKADLRLIYLALAHMIKFRGHFLIEGDLNPDNSDV
ST          LVEEKAYHDEFPTIYHLRKVLADSTKKADLRLVYLALAHMIKYRGHFLIEGEFNSKNNDI
LI          IEEEVEYHKNYPTIYHLREELVNSSEKADLRLVYLALAHIIKYRGNFLIEGALDTQNTSV
             :** :**:::*********: * :. :*.:****.****:**.****:. . ::..:
Motif:      *--*E--YH--**PTIYHLR*-L-*---K-DLRL*YLALAH*IK*RGNFLIEG-**--N--*
```

Fig. 2A

```
SM      QRLFQEFLAVYDNTFENSS------LQEQNVQVEEILTDKISKSAKKDRVLKLFPNEKSN
SP      DKLFIQLVQTYNQLFEENP------INASGVDAKAILSARLSKSRRLENLIAQLPGEKKN
ST      QKNFQDFLDTYNAIFESDL------SLENSKQLEEIVKDKISKLEKKDRILKLFPGEKNS
LI      DGIYKQFIQTYNQVFASGIEDGSLKKLEDNKDVAKILVEKVTRKEKLERILKLYPGEKSA
         : :::.*:.     .         . .. *   :.   .  :::: .: .:* .**.
Motif:  *-:-*-***--Y*--f-------------*----I*-----*--****--*:--*---P-EK--

SM      GRFAEFLKLIVGNQADFKKHFELEEKAPLQFSKDTYEEELEVLLAQIGDNYAELFLSAKK
SP      GLFGNLIALSLGLTPNFKSNFDLAEDAKLQLSKDTYDDDLDNLLAQIGDQYADLFLAAKN
ST      GIFSEFLKLIVGNQADFRKCFNLDEKASLHFSKESYDEDLETLLGYIGDDYSDVFLKAKK
LI      GMFAQFISLIVGSKGNFQKPFDLIEKSDIECAKDSYEEDLESLLALIGDEYAELFVAAKN
        * *.:   :: :  .:*:  *::  ..: *:::.*::: ::.* ** * ::*.:. **:
Motif:  G-F-***-L--*G----*F*--F*L-E-*---*K*Y***L*-LL--IGD*Y***F*-AK*

SM      LYDSILLSGILTVTDVGTKAPLSASMIQRYNEHQMDLAQLKQFIRQKLSDKYNEVFSDVS
SP      LSDAILLSDILRVNTEITKAPLSASMIKRYDEHHQDLTLLKALVRQQLPEKYKEIFFDQS
ST      LYDAILLSGFLTVTDNETEAPLSSAMIERFDTHEEDLGELKAFIKLHLPKHYEEIFSNTE
LI      AYSAVVLSSIITVAETETNAKLSASMIERFDTHEEDLGELKAFIKLHLPKHYEEIFSNTE
         : ::: *.::.*    *. :**:**:.*::  .:*  **.: :::*.:* : *  : .
Motif:  ---***LS-**-V----T*A-LS**MI*R**-H--DL--LK---*----Y*E*F-*--

SM      KDGYAGYIDGKTNQEAFYKYLKGLLNKIEGSSGYFLDKIEREDFLRKQRTFDNGSIPHQIH
SP      KNGYAGYIDGGASQEEFYKFIKPILERMDGTEELLVKLNREDLLRKQRTFDNGSIPHQIH
ST      KNGYAGYIDGKTNQEDFYVYLKKLLAEFEGADYFLEKIDREDFLRKQRTFDNGSIPYQIH
LI      KHGYAGYIDGKTKQADFYKYMKMTLENIEGADYFIAKIEKENFLRKQRTFDNGAIPHQLH
        *.********     **: : * .* .  *:. ::  ::.:.::****.****.**:*:*
Motif:  K-GYAGYIDG-*-Q--FY-K--L-*G*--*-K*E**LRKQRTFDNG*IP*Q*H
```

Fig. 2B

```
SM      LQEMRAIIRRQAEFYPFLADNQDRIEKLLTFRIPYYVGPLARGKSDFAWLSRKSADKITP
SP      LGELHAILRRQEDFYPFLKDNREKIEKILTFRIPYYVGPLARGNSRFAWMTRKSEETITP
ST      LQEMRAILDKQAKFYPFLAKNKERIEKILTFRIPYYVGPLARGNSDFAWSIRKRNEKITP
LI      LEELEAILHQQAKYYPFLKENYDKIKSLVTFRIPYFVGPLANGQSEFAWLTRKADGEIRP
        *  *:.***: .* . .:*****  . ::*:******:****** *.:.* *** * *
Motif:  L-E*-AI*-*Q--*YPFL--N-**I*-*TFRIPY*VGPLA-G*S-FAW--RK----I-P SM      WNFDEIVDKESSAEAFINRMTNYDLYLPNQKVLPKHSLLYEKFTVYNELTKVKYKTE-QG
SP      WNFEEVVDKGASAQSFIERMTNFDKNLPNEKVLPKHSLLYEYFTVYNELTKVKYVTEGMR
ST      WNFEDVIDKESSAEAFINRMTSFDLYLPEEKVLPKHSLLYETFNVYNELTKVRFIAESMR
LI      WNIEEKVDFGKSAVDFIEKMTNKDTYLPKENVLPKHSLCYQKYLVYNELTKVRYIND-QG
        ** :::  *: *  .** :**.   **::::****** *: :  *******::   *
Motif:  WN*-**-*D---SA--FI**MT---D--LP***VLPKHSL-Y*-*-VYNELTKV**--*--

SM      KTAFFDANMKQEIFDGVFRKVYRKVTKDKLMDFLEKEFDEFRIVDLTGLDKENKVFNASYG
SP      KPAFLSGEQKKAIVDLLFKTNRKVTVKQLKEDYFKKIECFDSVEISGVEDR---FNASLG
ST      DYQFLDSKQKKDIVRLYFKDKRKVTDKDIIEYL-HAIYGYDGIELKGIEKQ---FNSSLS
LI      KTSYFSGQEKEQIFNDLFKQKRKVKKKDLELFL-RNMSHVESPTIEGLEDS---FNSSYS
         :::: . :::: : ** ::*** : : : *        :  :   *:   **
Motif:  --*----*-K*--I----FK--RKV----*-*----*----G**----FN*S--

SM      TYHDLCKIL-DKDFLDNSKNEKILEDIVLTLTLFEDREMIRKRLENYSDLLTKEQVKKLE
SP      TYHDLLKI-IKDKDFLDNEENEDILEDIVLTLTLFEDREMIEERLKTYAHLFDDKVMKQLK
ST      TYHDLLNIINDKEFLDDSSNEAIIEEIIHTLTIFEDREMIKQRLSKFENIFDKSVLKKLS
LI      TYHDLLKVGIKQEILDNPVNTEMLENIVKILTVFEDKRMIKEQLQQFSDVLDGVVLKKLE
        *****    :   .::.*.**    ::* .** *:. :*  :  . :  :   * .
Motif:  TYHDL-*----***LD*--N--**E*I*--LT*FED*-MI-L-L----*K*L--

Fig. 2C
```

```
SM       RRHYTGWGRLSAELIHGIRNKESRKTILDYLIDDGNSNRNFMQLINDDALSFKEEIAKAQ
SP       RRRYTGWGRLSRKLINGIRDKQSGKTILDFLKSDGFANRNFMQLIHDDSLTFKEDIQKAQ
ST       RRHYTGWGKLSAKLINGIRDEKSGNTILDYLIDDGISNRNFMQLIHDDALSFKKKIQKAQ
LI       RRHYTGWGRLSAKLLMGIRDKQSHLTILDYLMNDDGLNRNLMQLINDSNLSFKSIIEKEQ
         **:.*****:**::**:***:*:   *****:*   *:. *****. :****..:*:*:*
Motif:   RR*YTGWG*LS-*L*-GIR-***S---TILD*L--D---NRN*MQLI*D--L*FK--I-K-Q SM       VIGETD--NLNQVVSDIAGSPAIKKGILQSLKIVDELVKIMG-HQPENIVVEMARENQFT
SP       VSGQGD--SLHEHIANLAGSPAIKKGILQSLKIVDELVKVMGRHKPENIVIEMARENQTT
ST       IIGDEDKGNIKEVVKSLPGSPAIKKGILQSIKIVDELVKVMGGRKPESIVVEMARENQYT                                    B
LI       VTTADK--DIQSIVADLAGSPAIKKGILQSLKIVDELVSVMG-YPPQTIVVEMARENQTT
         : .  .  .:   : .*.*:***********:******.:**   *  *:::*******
Motif:   *------*-----*--GSPAIKKGILQ-*K*VDELV-*MG---P*--IV*EMARENQ-T SM       NQGRRNSQQRLKGLTDSIKEFGSQILKEH------PVENSQLQNDRLFLYYLQNGRDMYT
SP       QKGQKNSRERMKRIEEGIKELGSQILKEH------PVENTQLQNEKLYLYLQNGRDMYV
ST       NQGKSNSQQRLKLEKSLKELGSKILKENIPAKLSKIDNNALQNDRLYLYLQNGKDMYT
LI       GKGKNNSRPRYKSLEKAIKEFGSQILKEH------PTDNQELRNNRLYLYLQNGKDMYT
         :*. :**: * *: :  :**:**:****.         :  **::** :********.
Motif:   -*G---NS*--R-K-*----*KE*GS*ILKE*--------*N--L*N**L*YYLQNG*DMY--

SM       GEELDIDYLSQYDIDHIIPQAFIKDNSIDNRVLTSSKENRGKSDDVPSKDVVRKMKSYWS
SP       DQELDINRLSDYDVDHIVPQSFLKDDSIDNKVLTRSDKNRGKSDNVPSEEVVKKMKNYWR             G
ST       GDDLDIDRLSNYDIDHIIPQAFLKDNSIDNKVLVSSASNRGKSDDVPSLEVVKKRKTFWY
LI       GQDLDIHNLSNYDIDHIVPQSFITDNSIDNLVLTSSAGNREKGDDVPPLEIVRKRKVFWE
         . :***.  *.** ***:**:*: *:****. :  .   :.*.:** : **:* *.*:
Motif:   -**LDI--LS*YD-DHI*PQ-F*-D*SIDN-VL--S--NR-K-D*VP---*V*K-K-*W-
```

Fig. 2D

```
SM      KLLSAKLITQRKFDNLTKAERGGLTDDDKAGFIKRQLVETRQITKHVARILDERFNTETD
SP      QLLNAKLITQRKFDNLTKAERGGLSELDKAGFIKRQLVETRQITKHVAQILDSRMNTKYD
ST      QLLKSKLISQRKFDNLTKAERGGLSPEDKAGFIQRQLVETRQITKHVARLLDEKFNNKKD
LI      KLYQGNLMSKRKFDYLTKAERGGLTEADKARFIHRQLVETRQITKNVANILHQRFNYEKD
        :*..:*::::*****.*******   ** :.*****:********:**.:**.::*  *
Motif:  *L----*L**RKFD-LTKAERGGL*---DKA-FI*RQLVETRQITK-*VA-*L--**N-*-D SM      ENNKKIRQVKIVTLKSNLVSNFRKEFELYKVREINDYHHAHDAYLNAVIGKALLGVYPQL
SP      ENDKLIREVKVVTLKSKLVSDFRKDFQFYKVREINNYHHAHDAYLNAVVGTALIKKYPKL
ST      ENNRAVRTVKIITTLKSTLVSQFRKDFELYKVREINDFHHAHDAYLNAVVASALLKKYPKL
LI      DHGNTMKQVRIVTLKSALVSQFRKQFQLYKVRDVNDYHHAHDAYLNGVVANTLLKVYPQL
        :..:  : .*:.****:***.***.*  ****::*:::********* :** :**  *:
Motif:  **-*---V*TLKS-LVS*FRK-F**LYKV*N**HHAHDAYLN-V*--*L--YP*L SM      EPEFVYGDYPHFHGHKE------NK-ATAKKFFYSNIMNFFKKDDVRTD-----------
SP      ESEFVYGDYKVYDYKVVDRKMIAKSEQEIGK-ATAKYFFYSNIMNFFKTEITLANGEIRKRPLI
ST      EPEFVYGDYPKYNSFRE------RKSATEKVFYFSNIMNIFKKSISLADGRVIERPLI
LI      DHGNTMKQVRIVTLKSALVSQFRKQFYTNIMLFFAQKDRIID-----------------
        :  ::    *.*  .     * ****    .    .
Motif:  E-EFVYGDY--*---*------------------K-AT-K---FY*NIM-*F---------

SM      -----KNGEIIWKKDEHISNIKKVLSYPQVNIVKKVEEQTGGFSKE-----------SILPK
SP      ETNGETGEIVWDKGRDFATVRKVLSMPQVNIVKKTEVQTGGFSKE-----------SILPK
ST      EVNEETGESVWNKESDLATVRRVLSYPQVNVKKKVEEQNHGLDRGKPKGLFNANLSSKPK
LI      -----ENGEILWDK-KYLDTVKKVMSYRQMNIVKKTEIQKGEFSKA-----------TIKPK
             .****:*.*    ::::.**..*  *:****.   ..:         :   **
Motif:  -----*-GE-*W-K---*-****V*M--Q*N*VKK-E-Q---*--*-----------PK
```

Fig.2E

```
SM      GNSDK-LIPRKTKKFYWDTKKYGGFDSPIVAYSILVIADIEKGKSKKLKTVKALVGVTIM
SP      RNSDK-LIARKKD---WDPKKYGGFDSPTVAYSVLVVAKVEKGKSKKLKSVKELLGITIM
ST      PNSNENLVGAKEY---LDPKKYGGYAGISNSFTVLVKGTIEKGAKKKITNVLEFQGISIL
LI      GNSSK-LIPRKTN---WDPMKYGGLDSPNMAYAVVI--EYAKGKN-KLVFEKKIIRVTIM
        * *  *: *      *  ****        *  ::::::: . :   *:  : ::*:
Motif:  -NS-*-L*--K----D--KYGG-------*******----KG--K*-----*--**I*

SM      EKMTFERDPVAFLERKGYRNVQEENIIKLPKYSLFKLENGRKLLAS------ARELQK
SP      ERSSFEKNPIDFLEAKGYKEVKKDLIIKLPKYSLFELENGRKRMLAS------AGELQK
ST      DRINYRKDKLNFLLEKGYKDI--ELIIELPKYSLFELSDGSRRMLASILSTNNKRGEIHK
LI      ERKAFEKDEKAFLEEQGYRQP--KVLAKLPKYTLYECEEGRRRMLAS------ANEAQK
        :: ::::*   **    *     : *****.*:: .:*  .:**         *  *
Motif:  **-*-*-----FL--*GY**-----*-*LPKY*L**-*-*G-*R*LAS------E-*K SM      GNEIVLPNHLGTLLYHAKNIHKV------DEPKHLDYDVDKHDEFKELLDVVSNFSKKYT
SP      GNELALPSKYVNFLYLASHYEKLKGSPEDNEQKQL-FVEQHKVLDEIIEQISEFSKRVI
ST      GNQIFLSQKFVKLLYHAKRISNT------INENHRKYVENHKKEFEELFYILEFNENYV
LI      GNQQVLPNHLVTLLHHAANCEVS------DGKSLDYIESNREMFAELLAHVSEFAKRYT
        **: : * : .:*  *:: :        :     *  ::*::*: ::* : :*:::
Motif:  GN*---L--*-----*L*-A--------*----*-*--*--E--*-*F-*--

SM      LAEGNLEKIKELYAQNNGEDLKELASSFI------NLLTFTAIGAPATFKFFDKNIDR
SP      LADANLDKVLSAYNKHRDKPIREQAENII------HLFTLTNLGAPAAFKYFDTTIDR
ST      GAKKNGKLLNSAFQSWQNHSIDELCSSFIGPTGSERKGLFELTSRGSAADFEFLGVKIPR
LI      LAEANLNKINQLFEQNKEGDIKAIAQSFV------DLMAFNAMGAPASFKFFETTIER
        *   :: :::  : :  : .   :: *       .   ::  *.. *::. :  : *
Motif:  -A--N--*---*---*--*-----*-----------L-*---G*-A-F***---I-R
```

Fig. 2F

```
SM  KR-YTSTTEILNATLIHQSITGLYETRIDLNKLGGD       (SEQ ID NO:1)
SP  KR-YTSTKEVLDATLIHQSITGLYETRIDLSQLGGD       (SEQ ID NO:2)
ST  YRDYTPSSLLKDATLIHQSVTGLYETRIDLAKLGEG       (SEQ ID NO:3)
LI  KR-YNNLKELLNSTIYQSITGLYESRKRLD----D        (SEQ ID NO:4)
     *  .   .   ::.**:.*****.*****:.*

Motif:  -R-Y-----*-***T*I*QS*TGLYE*R--L------
```

Fig. 2G

Alignment of the N terminal RuvC-like Domains disclosed in Chylinski et al.
(excluding sequence outliers).
(CLUSTAL format alignment by MAFFT (v7.058b))

```
1,12      DIGTNSVGWAVT    (SEQ ID NO:54)
3,20      DVGTNSVGWAVT    (SEQ ID NO:56)
15        DMGTNSVGWAVT    (SEQ ID NO:58)
4         DVGTSSVGWAVT    (SEQ ID NO:59)
7         DIGTASVGWAVT    (SEQ ID NO:60)
6         DVGTGSVGWAVT    (SEQ ID NO:61)
9         DIGTNSVGWAVV    (SEQ ID NO:62)
10        DIGTNSVGWAVI    (SEQ ID NO:63)
11        DIGTNSVGWAVL    (SEQ ID NO:64)
42        DLGTNSIGWAVV    (SEQ ID NO:65)
48        DLGTNSIGWAI-    (SEQ ID NO:66)
43        DLGTNSIGWALV    (SEQ ID NO:67)
2         DIGTNSVGWCVT    (SEQ ID NO:68)
14        DIGTNSVGYAVT    (SEQ ID NO:69)
5         DMGTGSLGWAVT    (SEQ ID NO:70)
16        DIGTSSVGWAAI    (SEQ ID NO:71)
8         DLGTGSVGWAVV    (SEQ ID NO:72)
22        DLGVSVGWAIV     (SEQ ID NO:73)
23        DLGIASIGWAII    (SEQ ID NO:74)
24        DLGIASVGWAIV    (SEQ ID NO:75)
25        DLGVASVGWNSIV   (SEQ ID NO:76)
26        DLGIASVGWAIL    (SEQ ID NO:77)
28        DLGISSVGWSVI    (SEQ ID NO:78)
32        DIGIASVGWSVI    (SEQ ID NO:79)
33        DVGIGSIGWAVI    (SEQ ID NO:80)
39        DLGVGSIGFAIV    (SEQ ID NO:81)
34        DIGYASIGWAVI    (SEQ ID NO:82)
47        DTGTNSLGWAIV    (SEQ ID NO:83)
50        DLGTNSIGWCLL    (SEQ ID NO:84)
49        DIGTDSLGWAVF    (SEQ ID NO:85)
18        DIGSNSIGFAVV    (SEQ ID NO:86)
41        DLGVGSIGVAVA    (SEQ ID NO:87)
45        DLGIASCGWGVV    (SEQ ID NO:88)
```

Fig. 3A

| | | |
|---|---|---|
| 21 | DLGIASVGWCLT | (SEQ ID NO:89) |
| 27 | DIGIGSVGVGIL | (SEQ ID NO:90) |
| 28 | DIGITSVGYGLI | (SEQ ID NO:91) |
| 29 | DIGITSVGFGII | (SEQ ID NO:92) |
| 30 | DVGITSTGYAVL | (SEQ ID NO:93) |
| 31 | DLGITSFGYAIL | (SEQ ID NO:94) |
| 40 | DIGNASVGWSAF | (SEQ ID NO:95) |
| 17 | DVGTNSCGWVAM | (SEQ ID NO:96) |
| 19 | DVGERSIGLAAV | (SEQ ID NO:97) |
| 35 | DVGLNSVGLAAV | (SEQ ID NO:98) |
| 36 | DVGLMSVGLAAI | (SEQ ID NO:99) |
| 37 | DVGTFSVGLAAI | (SEQ ID NO:100) |
| 38 | DIGTGSVGYACM | (SEQ ID NO:101) |
| 13 | DLGTTSIGFAHI | (SEQ ID NO:102) |
| 44 | DLGTNSIGSSVR | (SEQ ID NO:103) |
| 46 | * * * | |

Fig. 3B

Alignment of the N terminal RuvC-like Domains disclosed in Chylinski et al.
(CLUSTAL format alignment by MAFFT (v7.058b))

```
1,12    D------IGTNSVGWAVT    (SEQ ID NO:54)
3,20    -VGTNSVGWAVT          (SEQ ID NO:56)
15      ---MGTNSVGWAVT        (SEQ ID NO:58)
4       D------VGTSSVGWAVT    (SEQ ID NO:59)
7       D------IGTASVGWAVT    (SEQ ID NO:60)
6       ------VGTGSVGWAVT     (SEQ ID NO:61)
9       D------IGTNSVGWAVV    (SEQ ID NO:62)
10      D------IGTNSVGWAVI    (SEQ ID NO:63)
52      D------IGTNSIGWAVI    (SEQ ID NO:114)
11      D------IGTNSVGWAVI    (SEQ ID NO:64)
42      D------LGTNSVGWAVL    (SEQ ID NO:65)
48      D------LGTNSIGWAVV    (SEQ ID NO:66)
43      D------LGTNSIGWAI-    (SEQ ID NO:67)
2       D------LGTNSIGWALV    (SEQ ID NO:68)
14      D------IGTNSVGWCVT    (SEQ ID NO:69)
5       D------IGTNSVGYAVT    (SEQ ID NO:70)
16      D------MGTGSLGWAVT    (SEQ ID NO:71)
8       D------IGTSSVGWAAI    (SEQ ID NO:72)
22      D------LGTGSVGWAVV    (SEQ ID NO:73)
23      D------LGVGSVGWAIV    (SEQ ID NO:74)
24      D------LGIASIGWAII    (SEQ ID NO:75)
68      D------LGIASVGWAIV    (SEQ ID NO:127)
25      D------LGIASVGWAVV    (SEQ ID NO:76)
26      D------LGVASVGWSIV    (SEQ ID NO:77)
66      D------IGIASVGWAIL    (SEQ ID NO:130)
59      D------IGIASVGWAVL    (SEQ ID NO:131)
61      D------IGIASIGWAVI    (SEQ ID NO:132)
64      D------IGIASVGWAII    (SEQ ID NO:133)
62      D------VGIASVGWAVI    (SEQ ID NO:134)
67      D------IGIASVGWAL-    (SEQ ID NO:135)
32      D------IGIASVGWAMV    (SEQ ID NO:79)
28      D------LGISSVGWSVI    (SEQ ID NO:78)
63      D------IGITSVGWAVI    (SEQ ID NO:138)
```

Fig. 4A

| | | |
|---|---|---|
| 33 | D-------VGIGSIGWAVI | (SEQ ID NO:80) |
| 57 | D-------LGISSLGWAIV | (SEQ ID NO:140) |
| 39 | D-------LGVGSIGFAIV | (SEQ ID NO:81) |
| 34 | D-------IGYASIGWAVI | (SEQ ID NO:82) |
| 50 | D-------LGTNSIGWCLL | (SEQ ID NO:84) |
| 54 | D-------LGTNSIGWCLL | (SEQ ID NO:144) |
| 47 | D-------TGTNSLGWAIV | (SEQ ID NO:83) |
| 49 | D-------IGTDSLGWAVF | (SEQ ID NO:85) |
| 51 | D-------LGSTSLGWAIF | (SEQ ID NO:147) |
| 58 | D-------LGISSIGWAFS | (SEQ ID NO:148) |
| 21 | D-------LGIASVGWCLT | (SEQ ID NO:89) |
| 45 | D-------LGIASCGWGVV | (SEQ ID NO:88) |
| 18 | D-------IGSNSIGFAVV | (SEQ ID NO:86) |
| 65 | D-------IGTTSIGFSVI | (SEQ ID NO:152) |
| 29 | D-------IGITSVGYCLI | (SEQ ID NO:91) |
| 30 | D-------IGITSVGFGII | (SEQ ID NO:92) |
| 44 | D-------LGTTSIGFAHI | (SEQ ID NO:102) |
| 27 | D-------IGIGSVGVGIL | (SEQ ID NO:90) |
| 41 | D-------LGVGSIGVAVA | (SEQ ID NO:87) |
| 31 | D-------VGITSTGYAVL | (SEQ ID NO:93) |
| 40 | D-------LGITSFGYAIL | (SEQ ID NO:94) |
| 53 | D-------IGTSSIGWWLY | (SEQ ID NO:160) |
| 55 | D-------LGSNSLGWFVT | (SEQ ID NO:161) |
| 56 | D-------LGANSLGWFVV | (SEQ ID NO:162) |
| 17 | D-------IGNASVGWSAF | (SEQ ID NO:95) |
| 19 | D-------VGTNSCGWVAM | (SEQ ID NO:96) |
| 35 | D-------VGERSIGLAAV | (SEQ ID NO:97) |
| 36 | D-------VGLNSVGLAAV | (SEQ ID NO:98) |
| 37 | D-------VGLMSVGLAAI | (SEQ ID NO:99) |
| 38 | D-------VGTFSVGLAAI | (SEQ ID NO:100) |
| 13 | D-------IGTGSVGYACM | (SEQ ID NO:101) |
| 46 | D-------LGTNSIGSSVR | (SEQ ID NO:103) |
| 60 | DIGLRIGITSCGWSI- | (SEQ ID NO:171) |
| 69 | D-------MGAKYTGVFYA | (SEQ ID NO:172) |
| 73 | D-------LGGKNTGFFSF | (SEQ ID NO:173) |
| 74 | D-------LGVKNTGVFSA | (SEQ ID NO:174) |
| 70 | D-------LGAKFTGVALY | (SEQ ID NO:175) |
| 71 | D-------LGGKFTGVCLS | (SEQ ID NO:176) |
| 72 | D-------LGGTYTGTFIT | (SEQ ID NO:177) |

Fig. 4B

Alignment of the HNH-like Domains disclosed in Chylinski et al.
(CLUSTAL format alignment by MAFFT (v7.058b))

```
1   YDIDHIYPRS-LTKD----DSF-DNLVLCERTAN  (SEQ ID NO:178)
2   -DIDHIYPRSKVIKD----DSF-DNLVLVLKNEN  (SEQ ID NO:179)
3   -DRDHIYPQS-KIKD----DSI-DNLVLVNKTYN  (SEQ ID NO:180)
4   -DIDHIYPRS-KIKD----DSI-TNRVLVEKDIN  (SEQ ID NO:181)
6   -DIDHIYPQS-KIKD----DSI-SNRVLVCSSCN  (SEQ ID NO:182)
5   -DIDHIYPQS-KTMD----DSL-NNRVLVKKNYN  (SEQ ID NO:183)
7   -DQDHIYPKS-KIYD----DSL-ENRVLVKKNLN  (SEQ ID NO:184)
8   -QIDHIVPQS-LVKD----DSF-DNRVLVVPSEN  (SEQ ID NO:185)
9   -DIDHIIPQA-FIKD----NSI-DNRVLTSSKEN  (SEQ ID NO:186)
12  -DIDHIIPQA-FLKD----NSI-DNKVLVSSASN  (SEQ ID NO:187)
16  -DIDHIIPQA-YTKD----NSL-DNRVLVSNITN  (SEQ ID NO:188)
11  -DIDHIVPQS-FITD----NSI-DNLVLTSSAGN  (SEQ ID NO:189)
10  -DVDHIVPQS-FLKD----DSI-DNKVLTRSDKN  (SEQ ID NO:190)
14  -NIDHIYPQS-MVKD----DSL-DNKVLVQSEIN  (SEQ ID NO:191)
18  -DIDHILPQS-LIKD----DSL-DNRVLVNATIN  (SEQ ID NO:192)
19  -DIDHILPQS-FIKD----DSL-ENRVLVKKAVN  (SEQ ID NO:193)
13  -EVDHIFPRS-FIKD----DSI-DNKVLVIKKMN  (SEQ ID NO:194)
15  -EVDHIIPRS-YIKD----DSF-ENKVLVYREEN  (SEQ ID NO:195)
17  -DIDHIIPQA-VTQN----DSI-DNRVLVARAEN  (SEQ ID NO:196)
22  -EIDHIIPYS-ISFD----DSS-SNKLLVLAESN  (SEQ ID NO:197)
24  -EIDHIIPYS-LCFD----DSS-ANKVLVHKQSN  (SEQ ID NO:198)
32  -DIDHIIPYS-RSMD----DSY-SNKVLVLSGEN  (SEQ ID NO:199)
63  -DIDHIIPYS-KSMD----DSF-NNKVLCLAEEN  (SEQ ID NO:200)
59  -EIDHIIPYS-RSFD----DSY-MNKVLVFTKQN  (SEQ ID NO:201)
65  -QIDHIIPYS-RSMD----DSY-MNKVLVLTDEN  (SEQ ID NO:202)
64  -EIDHIIPFS-RSFD----DSI-SNKILVLGSEN  (SEQ ID NO:203)
68  -EIDHALPFS-RTWD----DSF-NNKVLVLGSEN  (SEQ ID NO:204)
69  -EIDHALPFS-RTWD----DSF-NNKVLVLASEN  (SEQ ID NO:205)
28  -EIDHIIPIS-ISLD----DSI-NNKVLVLSKAN  (SEQ ID NO:206)
30  -EIDHIIPIS-ISLD----DSI-TNKVLVTHREN  (SEQ ID NO:207)
62  -QVDHALPYS-RSYD----DSK-NNKVLVLTHEN  (SEQ ID NO:208)
27  -EVDHILPLS-ITFD----DSL-ANKVLVYATAN  (SEQ ID NO:209)
26  -EIDHIIPRS-ISFD----DAR-SNKVLVYRSEN  (SEQ ID NO:210)
```

Fig. 5A

| | | | |
|---|---|---|---|
| 29 | --EVDHIIPRS-VSFD------NSY-HNKVLVKQSEN | (SEQ ID NO:211) |
| 67 | --DIDHILPYS-ITFD------DSF-RNKVLVTSQEN | (SEQ ID NO:212) |
| 58 | --EIDHILPRS-RSAD------DSF-ANKVLCLARAN | (SEQ ID NO:213) |
| 51 | --EIEHLLPFS-LTLD------DSM-ANKTVCFRQAN | (SEQ ID NO:214) |
| 55 | --DIDHILPFS-VSLD------DSA-ANKVVCLREAN | (SEQ ID NO:215) |
| 57 | --DIDHLIPFS-ISWD------DSA-ANKVVCMRYAN | (SEQ ID NO:216) |
| 56 | --DIDHILPVA-MTLD------DSP-ANKIICMRYAN | (SEQ ID NO:217) |
| 54 | --DVDHILPYS-RTLD------DSF-PNRTLCLREAN | (SEQ ID NO:218) |
| 52 | --EIEHILPFS-RTLD------DSL-NNRTVAMRRAN | (SEQ ID NO:219) |
| 31 | --EVDHIIPYS-ISWD------DSY-TNKVLTSAKCN | (SEQ ID NO:220) |
| 45 | --QVDHILPWS-RFGD------DSY-LNKTLCTARSN | (SEQ ID NO:221) |
| 53 | --QVDHILPFS-KTLD------DSF-ANKVLAQHDAN | (SEQ ID NO:222) |
| 60 | --QIDHAFPLS-RSLD------DSQ-SNKVLCLTSSN | (SEQ ID NO:223) |
| 21 | --DIDHIVPRS-ISFD------DSF-SNLVIVNKLDN | (SEQ ID NO:224) |
| 23 | --EIEHIIPYS-MSYD------NSQ-ANKILTEKAEN | (SEQ ID NO:225) |
| 25 | --EIDHIVPYS-KSAD------DSW-FNKLLVKKSTN | (SEQ ID NO:226) |
| 49 | --EMDHILPYS-RSLD------NGW-HNRVLVHGKDN | (SEQ ID NO:227) |
| 33 | --EVDHIVPYS-LILD------NTI-NNKALVYAEEN | (SEQ ID NO:228) |
| 42 | --EIEHVIPQS-LYFD------DSF-SNKVICEAEVN | (SEQ ID NO:229) |
| 43 | --DIEHIIPQA-RLFD------DSF-SNKTLEARSVN | (SEQ ID NO:230) |
| 44 | --EIEHIVPKA-RVFD------DSF-SNKTLTFHRIN | (SEQ ID NO:231) |
| 20 | --DKDHIIPQS-MKKD------DSIINNLVLVNKNAN | (SEQ ID NO:232) |
| 66 | --EVEHIWPRS-RSFD------NSP-RNKTLCRKDVN | (SEQ ID NO:233) |
| 61 | --IVNHIIPYN-RSFD------DTY-HNRVLTLTETK | (SEQ ID NO:234) |
| 46 | --DMEHTIPKS-ISFD------NSD-QNLTLCESYYN | (SEQ ID NO:235) |
| 47 | --DIEHTIPRS-AGGD------STK-MNLTLCSSRFN | (SEQ ID NO:236) |
| 48 | --DIEHTIPRS-ISQD------NSQ-MNKTLCSLKFN | (SEQ ID NO:237) |
| 50 | --DIDHVIPLA-RGGR------DSL-DNMVLCQSDAN | (SEQ ID NO:238) |
| 39 | --DIEHLFPIA-ESED------NGR-NNLVISHSACN | (SEQ ID NO:239) |
| 41 | --DVDHIFPRD-DTAD------NSY-GNKVAHRQCN | (SEQ ID NO:240) |
| 40 | --DIEHIVPQS-LGGL------STD-YNTIVTLKSVN | (SEQ ID NO:241) |
| 35 | --ELDHIVPRT-DGGS------NRH-ENLAITCGACN | (SEQ ID NO:242) |
| 36 | --EMDHIVPRKGVGST------NTR-TNFAAVCAECN | (SEQ ID NO:243) |
| 37 | --EMDHIVPRKGVGST------NTR-VNLAAACAACN | (SEQ ID NO:244) |
| 38 | --EMDHIVPRAGQGST------NTR-ENLVAVCHRCN | (SEQ ID NO:245) |
| 70 | --EIDHIIPRS-LIKDARGIVFNAE-PNLIYASSRGN | (SEQ ID NO:246) |
| 71 | --EIDHIIPRS-LTGRTKKTVFNSE-ANLIYCSSKGN | (SEQ ID NO:247) |
| 73 | --EIDHIIPRS-LTLKKSESIYNSE-VNLIFVSAQGN | (SEQ ID NO:248) |

Fig. 5B

```
72  -EIDHIYPRS-LSKKHFGVIFNSE-VNLIYCSSQGN    (SEQ ID NO:249)
74  -EIDHILPRS-HTLKIYGTVFNPE-GNLIYVHQKCN    (SEQ ID NO:250)
75  -ELDHIIPRS-HKKY---GTLNDE-ANLICVTRGDN    (SEQ ID NO:251)
34  -ELEHIVPHS-FRQS------NAL-SSLVLTWPGVN    (SEQ ID NO:252)
     *:         *          .
```

Fig. 5C

Alignment of the HNH-like Domains disclosed in Chylinski et al. (excluding sequence
outliers). (CLUSTAL format alignment by MAFFT (v7.058b))

```
 1   YDIDHIYPRS-LTKDDS-FDNLVLCERTAN    (SEQ ID NO:178)
 2   -DIDHIYPRSKVIKDDS-FDNLVLVLKNEN    (SEQ ID NO:179)
 3   -DRDHIYPQS-KIKDDS-IDNLVLVNKTYN    (SEQ ID NO:180)
 4   -DIDHIYPRS-KIKDDS-ITNRVLVEKDIN    (SEQ ID NO:181)
 6   -DIDHIYPQS-KIKDDS-ISNRVLVCSSCN    (SEQ ID NO:182)
 5   -DIDHIYPQS-KTMDDS-LNNRVLVKKNYN    (SEQ ID NO:183)
 7   -DQDHIYPKS-KIYDDS-LENRVLVKKNLA    (SEQ ID NO:184)
 8   -QIDHIVPQS-LVKDDS-FDNRVLVVPSEN    (SEQ ID NO:185)
 9   -DIDHIIPQA-FIKDNS-IDNRVLTSSKEN    (SEQ ID NO:186)
12   -DIDHIIPQA-FLKDNS-IDNKVLVSSASN    (SEQ ID NO:187)
16   -DIDHIIPQA-YTKDNS-LDNRVLVSNITN    (SEQ ID NO:188)
11   -DIDHIVPQS-FITDNS-IDNLVLTSSAGN    (SEQ ID NO:189)
10   -DVDHIVPQS-FLKDDS-IDNKVLTRSDKN    (SEQ ID NO:190)
14   -NIDHIYPQS-MVKDDS-LDNKVLVQSEIN    (SEQ ID NO:191)
18   -DIDHILPQS-LIKDDS-LDNRVLVNATIN    (SEQ ID NO:192)
19   -DIDHILPQS-FIKDDS-LENRVLVKKAVN    (SEQ ID NO:193)
13   -EVDHIFPRS-FIKDDS-IDNKVLVIKKMN    (SEQ ID NO:194)
15   -EVDHIIPRS-YIKDDS-FENKVLVYREEN    (SEQ ID NO:195)
17   -DIDHIIPQA-VTQNDS-IDNRVLVARAEN    (SEQ ID NO:196)
21   -DIDHIVPRS-ISFDDS-FSNLVIVNKLDN    (SEQ ID NO:224)
22   -EIDHIIPYS-ISFDDS-SSNKLLVLAESN    (SEQ ID NO:197)
24   -EIDHIIPYS-LCFDDS-SANKVLVHKQSN    (SEQ ID NO:198)
28   -EIDHIIPIS-ISLDDS-INNKVLVLSKAN    (SEQ ID NO:206)
30   -EVDHIIPIS-ISLDDS-ITNKVLVTHREN    (SEQ ID NO:207)
27   -EVDHILPLS-ITFDDS-LANKVLVYATAN    (SEQ ID NO:209)
26   -EIDHIIPRS-ISFDDA-RSNKVLVYRSEN    (SEQ ID NO:210)
29   -EVDHIIPRS-VSFDNS-YHNKVLVKQSEN    (SEQ ID NO:211)
31   -EVDHIIPYS-ISWDDS-YTNKVLTSAKCN    (SEQ ID NO:220)
32   -DIDHIIPYS-RSMDDS-YSNKVLVLSGEN    (SEQ ID NO:199)
23   -EIEHIIPYS-MSYDNS-QANKILTEKAEN    (SEQ ID NO:225)
33   -EVDHIVPYS-LILDNT-INNKALVYAEEN    (SEQ ID NO:228)
25   -EIDHVIPYS-KSADDS-WFNKLLVKKSTN    (SEQ ID NO:226)
49   -EMDHILPYS-RSLDNG-WHNRVLVHGKDN    (SEQ ID NO:227)
42   -EIEHIIPQS-LYFDDS-FSNKVICEAEVN    (SEQ ID NO:229)
43   -DIEHIIPQA-RLFDDS-FSNKTLEARSVN    (SEQ ID NO:230)
```

Fig. 6A

| | | |
|---|---|---|
| 44 | -EIEHIVPKA-RVFDDS-FSNKTLTFHRIN | (SEQ ID NO:231) |
| 20 | -DKDHIIPQS-MKKDDSIINNLVLVNKNAN | (SEQ ID NO:232) |
| 45 | -QVDHILPWS-RFGDDS-YLNKTLCTARSN | (SEQ ID NO:221) |
| 50 | -DIDHVIPLA-RGGRDS-LDNMVLCQSDAN | (SEQ ID NO:238) |
| 46 | -DMEHTIPKS-ISFDNS-DQNLTLCESYYN | (SEQ ID NO:235) |
| 47 | -DIEHTIPRS-AGGDST-KMNLTLCSSRFN | (SEQ ID NO:236) |
| 48 | -DIEHTIPRS-ISQDNS-QMNKTLCSLKFN | (SEQ ID NO:237) |
| 39 | -DIEHLFPIA-ESEDNG-RNNLVISHSACN | (SEQ ID NO:239) |
| 41 | -DVDHIFPRD-DTADNS-YGNKVVAHRQCN | (SEQ ID NO:240) |
| 40 | -DIEHIVPQS-LGGLST-DYNTIVTLKSVN | (SEQ ID NO:241) |
| 35 | -ELDHIVPRT-DGGSNR-HENLAITCGACN | (SEQ ID NO:242) |
| 36 | -EMDHIVPRKGVGSTNT-RTNFAAVCAECN | (SEQ ID NO:243) |
| 37 | -EMDHIVPRKGVGSTNT-RVNLAAACAACN | (SEQ ID NO:244) |
| 38 | -EMDHIVPRAGQGSTNT-RENLVAVCHRCN | (SEQ ID NO:245) |
| 34 | -ELEHIVPHS-FRQSNA-LSSLVLTWPGVN | (SEQ ID NO:252) |

Fig. 6B

Sequence alignment between SpCas9 and NmCas9

```
                                                         Y
NmCas9    MAAFKPNSINYILGL DIGIASVGWAMV EIDEEENPIRLID------------LGVRVFE
SpCas9    ------MDKKYSIGL DIGTNSVGWAVI TDEYKVPSKKFKVLGNTDRHSIKKNLIGALLFD
          ---------*Y-*GL DIG--SVGWA** -*-*----**------------*G---*F*

NmCas9    RAEVPKTGDSLAMARRLARSVRRLTRRAHRLLRTRRLLKREGVLQAA-------------
SpCas9    SGET-------AEATRLKRTARRRYTRRKNRICYLQEIFSNEMAKVDDSFFHRLEESFLV
          --E--------A-A-RL-R*-RR---RR--R*---*-**--E------------------

NmCas9    ---------------NFDENGLIKSLPNTPWQLRAAALDRK---LTPLEWSAVLLHLIKHR
SpCas9    EEDKKHERHPIFGNIVDEVAYHEKYP-TIYHLRKKLVDSTDKADLRLI-YLALAHMIKFR
          ---------------DE----*--P-T **LR----*D---------L-----L-H*IK-R

NmCas9    GYLSQRKNE-----------------------------GETA----------DKEL---
SpCas9    GHFLIEGDLNPDNSDVDKLFIQLVQTYNQLFEENPINASGVDAKAILSARLSKSRRLENL
          G**----*-----------------------------G--A----------*-L---

NmCas9    -----GALLKGVAGNAHALQTG---DFRTPAE------LAL--NKFEKESGHIRNQ-RSD
SpCas9    IAQLPGEKKNGLFGNLIALSLGLTPNFKSNFDLAEDAKLQLSKDTYDDDLDNLLAQIGDQ
          -----G---*G*-GN--AL--G----*F**--*------L-L--*-*-*----*--Q---*

NmCas9    YSHTFSR-----------------------------------------------KDLQA
SpCas9    YADLFLAAKNLSDAILLSDILRVNTEITKAPLSASMIKRYDEHHQDLTLLKALVRQQLPE
          Y*--F-------------------------------------------------**L--

NmCas9    ELILLFEKQKEFGN-PHVSGGLK-----------------EGIETL---------LMTQRPA
SpCas9    KYKEIFFDQSKNGYAGYIDGGASQEEFYKFIKPILEKMDGTEELLVKLNREDLLRKQRTF
          *----*F--Q-*-G---**-GG----------------*G-E-L---------L--QR--

NmCas9    LSGDAV-QKMLGH-------CTFEPAEP---------------KAAKNTYTAERFIWL
SpCas9    DNGSIPHQIHLGELHAILRRQEDFYPFLKDNREKIEKILTFRIPYYVGPLARGNSRFAWM
          --G----Q--LG-----------F-P----------------------*----RF-W*

NmCas9    TKLNNLRILEQGSERPLTD--------TERATLMDEPY------RKSKLTYAQAR------
SpCas9    TRKSEETITPWNFEEVVDKGASAQSFIERMTNFDKNLPNEKVLPKHSLLYEYFTVYNELT
          T*--**--I-----E---*---------ER-T-*D*------K--L-Y----------

NmCas9    ----KLLGLEDTAFFKGLRY--------GKDN-------------------------AEA
SpCas9    KVKYVTEGMRKPAFLSGEQKKAIVDLLFKTNRKVTVKQLKEDYFKKIECFDSVEISGVED
          -------G*---AF*-G-*-----------*--------------------------E-

NmCas9    STLMEMKAYHAISRALEKEGLKDKKSPLNLSPELQDEIGTAFSLFKTDEDITGRLKDRIQ
SpCas9    RFNASLGTYHDLLKIIKDKDFLDNEE----NEDILEDIVLTLTLFEDREMIEEERLKTYAH
          -----*-*YH-*-*-**-*-*-D**-------**--**I---***LF*---E-I--RLK---*

NmCas9    P--EILEALLKHISFDKFVQISLKALRRIVPLMEQGKRYDEACAE----IYGDHYGKKNT
SpCas9    LFDDKVMKQLKRRRYTGWGRLSRKLI--------NGIRDKQSGKTILDFLKSDGFANRNF
          ---*-*---LK*---*-*-**S-K-*---------*G-R--**--------*--D-*-**N-

NmCas9    EEKI------Y-----------------LPPIPADEIRNPVVLRALSQARKVINGVVRRYG-
SpCas9    MQLIHDDSLTFKEDIQKAQVSGQGDSLHEHIANLAGSPAIKKGILQTVKVVDELVKVGR
          -*-I------*-----------------L----A*----P-*-*-*-Q*-KV**-*V*---G-

NmCas9    -SPAR IHIETARE VGKSFKDRKEIEKRQEENRKDREKAAAKFREYFPNF----VGEPKSK
SpCas9    HKPEN IVIEMAREN QTTQKGQKQNSRER-------MKRIEEGIKELGSQILKEHPVENTQL
          --P-- I-IE-ARE ---*-K-*K--*-R-------**------**E---**------E----

B ↓                         G ↓
NmCas9    DILKLRLYEQQHGKCLYSGKEINLGRL NEKGYV EIDHALPFSRTWDDSFNNKVLVLGSEN
SpCas9    QNEKLYLYYLQNGRDMYVDQELDINRLSD--- Y DVDHIVPQSFLKDDSIDNKVLTRSDKN
          *--KL-LY--Q-G*-*Y--*E*** RL-*---- **DH-*P-S---DDS**NKVL----*N

NmCas9    QNKGNQTPYEYFNGKDNSREWQEFKA-RVET-SRFP-RSKKQRILLQKFDEDGFKERNLN
SpCas9    RGKSDNVPSEEVVKKM-KNYWRQLLNAKLITQRKFDNLTKAERGGLSELDKAGFIKRQLV
          *  K--P-E----K-----W*---**-T---*K-*R--L-**D*-GF-*R*L-
```

Fig. 7A

```
NmCas9   DTRYVNRFLCQFVADRMRLTGKGKKRVF------ASNGQITNLLRGFWGLRKVRAENDRH
SpCas9   ETRQITKHVAQILDSRMNTKYDENDKLIREVKVITLKSKLVSDFRKDFQFYKVREINNYH
         *TR-*-*-*-Q**--RM------*-***------*-*-**---*R--*-*-KVR--N*-H

NmCas9   HALDAVVVACSTVAMQQKI---TRFVRYKEMNAFDGKTID----KETGEVLHQKTHFPQP
SpCas9 B HAHDAYLNAVVGTALIKKYPKLESEFVYGDYKVYDVRKMIAKSEQEIGKATAKYFFYSNI
         HH-AD-*-A----A*-*K---------Y-*-*-*D-*-*-----*E-G*---*---*-*-

NmCas9   WEFFAQEVMIRVFGKPDGKPE-----------FEEADTLEKLRTLLAEKLSSRPEAVHEY
SpCas9   MNFFKTEITLA-NGEIRKRPLIETNGETGEIVWDKGRDFATVRKVLS-----MPQ-----
         -*FF--E*-*---G*----*P---------***---*--*R-*L*------P*-----

NmCas9   VTPLFVSRAPNRKMSGQGHMETVKSAKRLDEGVSVLRVPLTQLKLKDLEKMVN--REREP
SpCas9   -------------------VNIVKKTEVQTGGFSKES----ILPKRNSDKLIARKKDWDP
         --------------------VK-----G-S--------L--**-*K----*P

NmCas9   KLYEALKARLEAHKDDPAKAFAEPPFYKYDKAGNRTQQVKAVR---VEQVQKTGVWVRNH-
SpCas9   KKYGGFD--------SPTVAYSVLVVAKVEKGK-SKKLKSVKELLGITIMERSSFEKNPI
         K-Y--*---------P*-A**--------*-G*-****K*V*------*--*---*-*N--

NmCas9   -----NGIAD-------------------NATMVRVDVFEKGDKYYLVPIY-------
SpCas9   DFLEAKGYKEVKKDLIIKLPKYSLFELENGRKRMLASAGELQKGNELALPSKYVNFLYLA
         -----*G--*---------------*---*-------KG--L---Y-------

NmCas9   -SWQVAKGILPDRAVVQGKDEEDWQLIDDS------FNFKFSLHPNDLVEVI--------
SpCas9   SHYEKLKGSPEDNEQKQLFVEQHKHYLDEIIEQISEFSKRVILADANLDKVLSAYNKHRD
         --**--KG---D----Q---E*--*-*D*------F--*--L----*L-*V*--------

NmCas9   -----------------TKKARMFGYFASCHRGTGNINIRIHDLDHKIGKNGILEGIGV
SpCas9   KPIREQAENIIHLFTLTNLGAPAAFKYFDTTIDRKRYTS-TKEVLDATLIHQSI------
         ----------------------F-YF-*------------LD--*-**-I------

NmCas9   KTALSFQKYQIDELGKEIRPCRLKKRPPVR    (SEQ ID NO:6)
SpCas9   -TGLYETRIDLSQLGGD-------------    (SEQ ID NO:7)
         -T-L---*-**-*LG-*-------------
```

Percent Identity Matrix - created by Clustal2.1

Fig. 7B

Sequence of the NmCas9 ORF with dual NLS and HA tags

```
atg[gtgcctaagaagaagagaaaggtgg]ctgccttcaaacctaattcaatcaactacatcctcggcctcgat
                    R
atcggcatcgcatccgtcggctgggcgatggtagaaattgacgaagaagaaaacccatccgcctgattgat
ttgggcgtgcgcgtatttgagcgtgccgaagtaccgaaaacaggcgactcccttgccatggcaaggcgtttg
gcgcgcagtgttcgccgcctgaccgccgtcgcgcccaccgcctgcttcggaccgccgcctattgaaacgc
gaaggcgtattacaagccgccaattttgacgaaaacggcttgattaaatccttaccgaatacaccatggcaa
cttcgcgcagccgcattagaccgcaaactgacgcctttagagtggtcggcagtcttgttgcatttaatcaaa
catcgcggctatttatcgcaacggaaaaacgagggcgaaactgccgataaggagcttggcgctttgcttaaa
ggcgtagccggcaatgcccatgccttacagacaggcgatttccgcacaccggccgaattggctttaaataaa
tttgagaaagaaagcggccatatccgcaatcagcgcagcgattattcgcatacgttcagccgcaaagattta
caggcggagctgattttgctgtttgaaaaacaaaaagaatttggcaatccgcatgtttcaggcggccttaaa
gaaggtattgaaaccctactgatgacgcaacgccctgccctgtccggcgatgccgttcaaaaaatgttgggg
cattgcaccttcgaaccggcagagccgaaagccgctaaaaacacctacacagccgaacgtttcatctggctg
accaagctgaacaacctgcgtatttagagcaaggcagcgagcggccattgaccgataccgaacgcgccacg
cttatggacgagccatacagaaaatccaaactgacttacgcacaagcccgtaagctgctgggtttagaagat
accgcctttttcaaaggcttgcgctatggtaaagacaatgccgaagcctcaacattgatggaaatgaaggcc
taccatgccatcagccgtgcactggaaaaagaaggattgaaagacaaaaaatccccattaaacctttctccc
gaattacaagacgaaatcggcacggcattctccctgttcaaaaccgatgaagacattacaggccgtctgaaa
gaccgtatacagcccgaaatcttagaagcgctgttgaaacacatcagcttcgataagttcgtccaaatttcc
ttgaaagcattgcgccgaattgtgcctctaatggaacaaggcaaacgttacgatgaagcctgcgccgaaatc
tacggagaccattacggcaagaagaatacggaagaaaagatttatctgccgccgattccgccgacgaaatc
cgcaacccgtcgtcttgcgcgccttatctcaagcacgtaaggtcattaacggcgtggtacgccgttacggc
tccccagctcgtatccatattgaaactgcaagggaagtaggtaaatcgtttaaagaccgcaaagaaattgag
aaacgccaagaagaaaaccgcaaagaccgggaaaaagccgccgccaaattccgagagtatttccccaatttt
gtcggagaacccaaatccaaagatattctgaaactgcgcctgtacgagcaacaacacggcaaatgcctgtat
tcgggcaaagaaatcaacttaggccgtctgaacgaaaaaggctatgtcgaaatcgaccatgccctgccgttc
tcgcgcacatgggacgacagtttcaacaataaagtactggtattgggcagcgaaaaccaaaacaaaggcaat
caaaccccttacgaatacttcaacggcaaagacaacagccgcgaatggcaggaatttaaagcgcgtgtcgaa
accagccgtttcccgcgcagtaaaaaacaacggattctgctgcaaaaattcgatgaagacggctttaaagaa
cgcaatctgaacgacacgcgctacgtcaaccgtttcctgtgtcaatttgttgccgaccgtatgcggctgaca
ggtaaaggcaagaaacgtgtctttgcatccaacggacaaattaccaatctgttgcgcggcttttggggattg
cgcaaagtgcgtgcggaaaacgaccgccatcacgccttggacgccgtcgtcgttgcctgctcgaccgttgcc
atgcagcagaaaattacccgttttgtacgctataaagagatgaacgcgtttgacggtaaaaccatagacaaa
gaaacaggagaagtgctgcatcaaaaaacacacttcccacaaccttgggaattttttcgcacaagaagtcatg
attcgcgtcttcggcaaaccggacggcaaacccgaattcgaagaagccgatacctagaaaaactgcgcacg
ttgcttgccgaaaaattatcatctcgccccgaagccgtacacgaatacgttacgccactgtttgtttcacgc
gcgcccaatcggaagatgagcgggcaagggcatatggagaccgtcaaatccgccaaacgactggacgaaggc
gtcagcgtgttgcgcgtaccgctgacacagttaaaactgaaagacttggaaaaaatggtcaatcgggagcgc
gaacctaagctatacgaagcactgaaagcacggctggaagcacataagacgatcctgccaaagcctttgcc
gagccgttttacaaatacgataaagcaggcaaccgcacccaacaggtaaaagccgtacgcgtagagcaagta
cagaaaaccggcgtatgggtgcgcaaccataacggtattgccgacaacgcaaccatggtgcgcgtagatgtg
tttgagaaaggcgacaagtattatctggtaccgatttacagttggcaggtagcgaaagggattttgccggat
agggctgttgtacaaggaaaagatgaagaagattggcaacttattgatgatagtttcaactttaaattctca
ttacaccctaatgatttagtcgaggttataacaaaaaaagctagaatgtttggttactttgccagctgccat
cgaggcacaggtaatatcaatatacgccattcatgatcttgatcataaaattggcaaaaatggaatactggaa
ggtatcggcgtcaaaaccgccctttcattccaaaaataccaaattgacgaactgggcaaagaaatcagacca
tgccgtctgaaaaaacgcccgcctgtccgt[tacccatacgatgttccagattacgct]gcagctccagcagcg
                                              G      (SEQ ID NO:303)
[aagaaaaagaagctggat]taa
                           O
```

R: SV40 NLS, G: HA tag, O: synthetic NLS (1); all else NmCas9

Fig. 8

CRISPR/CAS-RELATED METHODS AND COMPOSITIONS FOR TREATING USHER SYNDROME AND RETINITIS PIGMENTOSA

REFERENCE TO RELATED APPLICATIONS

The present application is a U.S. national phase of International Application No. PCT/US15/19064, filed Mar. 5, 2015, which claims the benefit of U.S. Provisional Application No. 61/948,520, filed Mar. 5, 2014, the contents of which are hereby incorporated by reference in their entirety, including drawings.

FIELD OF THE INVENTION

The invention relates to CRISPR/Cas-related methods and components for editing of a target nucleic acid sequence, and applications thereof in connection with Usher syndrome and retinitis pigmentosa.

BACKGROUND

Usher Syndrome is a common form of inherited combined hearing and vision loss. It affects 1 in 6,000 individuals (Kimberling et al., Genetics in Medicine 2010; 12(8): 512-516). Usher Syndrome is known to be caused by mutations in at least 9 different genes. Usher syndrome type IIA is caused by mutations in the USH2A gene (also known as the RP39 gene). Usher syndrome type II accounts for approximately 50% of all Usher cases (Eudy et al., Science 1998; 280(5370):1753-1757). Usher syndrome type IIA accounts for approximately 80% of all Usher type II cases (Le Quesne Stabel et al., Journal of Molecular Genetics 2012; 49(1):27-36), or 40% of all Usher cases.

The USH2A gene is 800,503 base pairs and codes for the usherin protein (1,551 amino acids in length). A common mutation in subjects with Usher syndrome type II or non-syndromic retinitis pigmentosa (RP39) is a single nucleotide deletion, e.g., a guanine deletion, at nucleotide position c.2299 (2299delG) in the USH2A gene, which is responsible for between 15% and 78% of USH2A mutations, depending on the population (Baux et al. European Journal of Human Genetics 2010; 18:788-793. Yan et al., Journal of Human Genetics 2009; 54:732-738. Weston et al., American Journal of Human Genetics 2000; 66(4):1199-1210). The deletion of guanine at position 2299 results in a premature stop codon, which leads to a truncated usherin protein. The truncated usherin protein disrupts vision and hearing, leading to visual and hearing loss.

Visual loss in Usher syndrome usually begins between the ages of 10 and 20. The vision loss is described as retinitis pigmentosa (RP), a retinal dystrophy that tends to affect peripheral visual fields initially. The visual field defect generally progresses inwards, constricting the subject's visual field and over time leading to blindness. Subjects commonly experience loss of night vision early in the disease, followed by loss of peripheral vision, followed by loss of visual acuity (a measure of the central visual field).

The visual loss associated with Usher syndrome type II is called 'syndromic' retinitis pigmentosa, because it is frequently associated with hearing loss. Alternatively, patients can have mutations in USH2A that are not associated with hearing loss. In this case, the patients are defined as having 'non-syndromic' retinitis pigmentosa. Non-syndromic retinitis pigmentosa caused by mutations in the USH2A gene may be called retinitis pigmentosa 39, or RP39.

Usher syndrome also causes deafness. In Usher syndrome type IIA, the age of onset of deafness is most often at birth and consists of moderate to severe hearing impairment which is generally non-progressive. However, in subjects with Usher type IIA, hearing loss may present after birth into teenage years and may be progressive. Usher syndrome type IIA subjects have normal vestibular function. Usher type I subjects are generally born profoundly deaf with absent vestibular function.

Treatment for the visual loss associated with Usher syndrome type IIA and/or RP-39 is limited. There is currently no approved treatment that substantially reverses or halts the progression of disease in Usher syndrome type 2 or in RP-39. Vitamin A supplementation may delay onset of disease and slow progression. An electrical implant known as the *Argus* II retinal implant was recently approved for use, but it only offers minimal improvement in vision in patients with RP. The best visual acuity achieved in trials by the device was 20/1260 (legal blindness is defined as 20/200 vision). In addition, current gene therapy delivery techniques are not able to deliver genes encoding large proteins, e.g., the USH2A gene.

There is also no curative treatment for hearing loss in Usher syndrome type IIA. Subjects with Usher syndrome commonly use hearing aids and cochlear implants. Both are helpful in providing some degree of auditory function but do not restore hearing. Subjects would benefit greatly from a therapeutic which restored hearing and/or prevented further hearing loss.

Despite advances that have been made in gene therapy and by using cochlear implants, there remains a need for therapeutics to treat the visual loss and deafness associated with Usher syndrome, including Usher syndrome type IIA, and retinitis pigmentosa.

SUMMARY OF THE INVENTION

Methods and compositions discussed herein, allow the correction of genetic disorders of the eye and the inner ear, e.g., disorders that affect retinal cells (e.g., photoreceptor cells), cells of the inner ear (e.g., inner hair cells or outer hair cells), or both.

Methods and compositions discussed herein, provide for treating or delaying the onset or progression of Usher syndrome and retinitis pigmentosa, e.g., Usher Syndrome type IIA (USH2A, USHIIA) and retinitis pigmentosa 39 (RP39). Symptoms associated with Usher syndrome and retinitis pigmentosa, such as vision loss and hearing loss, can also be treated by the methods and compositions disclosed herein.

Methods and compositions discussed herein, provide for treating or delaying the onset or progression of a disorder caused by mutations in the USH2A gene, including the mutation 2299delG (which causes a premature termination codon).

Methods and compositions discussed herein, provide for treating or delaying the onset or progression of usher syndrome and retinitis pigmentosa, e.g., Usher Syndrome type IIA (USH2A, USHIIA) and retinitis pigmentosa 39 (RP39) by gene editing, e.g., using CRISPR-Cas9 mediated methods to correct the guanine deletion at position 2299 in the USH2A gene (e.g., replace the deleted guanine residue at position 2299 in the USH2A gene).

In one aspect, disclosed herein is a gRNA molecule, e.g., an isolated or non-naturally occurring gRNA molecule, comprising a targeting domain which is complementary with a target domain from the USH2A gene. USH2A is also known as US2, RP39, USH2, and dJ1111A8.1.

In an embodiment, the targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG) in the USH2A gene.

In an embodiment, the targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG). In an embodiment, the targeting domain comprises a sequence that is the same as, or differs by no more than 1, 2, 3, 4, or 5 nucleotides from, a targeting domain sequence from Table 1. In some embodiments, the targeting domain is selected from those in Table 1. For example, in certain embodiments, the targeting domain is

```
                                    (SEQ ID NO: 392)
         GAGUGCAAAAAAGAAGCCAA;

(SEQ ID NO: 393)
         GUUAGAUGUCACCAAUUGUA;

(SEQ ID NO: 394)
         GGUGUCACACUGAAGUCCUU;

(SEQ ID NO: 395)
         GCCAUGGAGGUUACACUGGC;

(SEQ ID NO: 396)
         GUCACAGGCCUUACAAU;

(SEQ ID NO: 397)
         GUCACACUGAAGUCCUU;

(SEQ ID NO: 398)
         UGCAAAAAAGAAGCCAA;

(SEQ ID NO: 399)
         UGCAGAGAAAACUUUUA;

(SEQ ID NO: 400)
         UGUUCACUGAGCCAUGG;
         or (SEQ ID NO: 401)
         AUGGAGGUUACACUGGC.
```

In other embodiments, the targeting domain comprises a sequence that is the same as, or differs by no more than 1, 2, 3, 4, or 5 nucleotides from, a targeting domain sequence from Table 2. In an embodiment, the targeting domain is selected from Table 2.

In other embodiments, the targeting domain comprises a sequence that is the same as, or differs by no more than 1, 2, 3, 4, or 5 nucleotides from, a targeting domain sequence from Table 3. In an embodiment, the targeting domain is selected from Table 3.

In other embodiments, the targeting domain comprises a sequence that is the same as, or differs by no more than 1, 2, 3, 4, or 5 nucleotides from, a targeting domain sequence from Tables 4A-4E. In an embodiment, the targeting domain is selected from Tables 4A-4E.

In certain embodiments, the targeting domain is

```
                                    (SEQ ID NO: 402)
         GCAAGCCCAAUGUUGAA;
```

-continued
```
                                    (SEQ ID NO: 403)
         GCAUUACAGACAGUCCC;

(SEQ ID NO: 397)
         GUCACACUGAAGUCCUU;

(SEQ ID NO: 396)
         GUCACAGGCCUUACAAU;

(SEQ ID NO: 406)
         GUCUGUAAUGCUAAGAC;

(SEQ ID NO: 407)
         GACACAGCUGGAUCCCUCCC;

(SEQ ID NO: 408)
         GAGACAGUGCAAUAAAUGUU;

(SEQ ID NO: 409)
         GCACUACACUGCCCAGAGUG;

(SEQ ID NO: 410)
         GCACUGUCUCCCUUCAACAU;

(SEQ ID NO: 395)
         GCCAUGGAGGUUACACUGGC;

(SEQ ID NO: 412)
         GCCUGUGACUGUGACACAGC;

(SEQ ID NO: 394)
         GGUGUCACACUGAAGUCCUU;
         or (SEQ ID NO: 393)
         GUUAGAUGUCACCAAUUGUA.
```

In other embodiments, the targeting domain comprises a sequence that is the same as, or differs by no more than 1, 2, 3, 4, or 5 nucleotides from, a targeting domain sequence from Tables 5A-5F. In an embodiment, the targeting domain is selected from Tables 5A-5F.

In certain embodiments, the targeting domain is

```
                                    (SEQ ID NO: 415)
         GCACUACACUGCCCAGAGU;

(SEQ ID NO: 416)
         GCCUGUGACUGUGACACAG;

(SEQ ID NO: 417)
         GGCCUGUGACUGUGACACAG;

(SEQ ID NO: 418)
         GGUGUGAUCAUUGCAAUU;

(SEQ ID NO: 419)
         GACACCUGCAGAGAAAACUUUU;

(SEQ ID NO: 420)
         GCAUUACAGACAGUCCCAGGG;

(SEQ ID NO: 421)
         GCUUAGGUGUGAUCAUUGCAAUU;

(SEQ ID NO: 422)
         GCUUCUUUUUUGCACUACACUGCC;

(SEQ ID NO: 423)
         GGCUUAGGUGUGAUCAUUGCAAUU;

(SEQ ID NO: 424)
         GUAAGGCCUGUGACUGUGACACAG;
         or (SEQ ID NO: 425)
         GUGACACCUGCAGAGAAAACUUUU.
```

In other embodiments, the targeting domain comprises a sequence that is the same as, or differs by no more than 1, 2, 3, 4, or 5 nucleotides from, a targeting domain sequence from Tables 6A-6D. In an embodiment, the targeting domain is selected from Tables 6A-6D.

In certain embodiments, the targeting domain is

GUGUCACACUGAAGUCC;  (SEQ ID NO: 426)

GGUGUGAUCAUUGCAAU;  (SEQ ID NO: 427)
or

GGGCUCACAUCCAACAUCAU.  (SEQ ID NO: 428)

In an embodiment, the gRNA, e.g., a gRNA comprising a targeting domain which is complementary with a target domain from the USH2A gene, is a modular gRNA. In other embodiments, the gRNA is a chimeric gRNA.

In an embodiment, when two gRNAs are used to position two breaks, e.g., two single strand breaks, in the target nucleic acid sequence, each guide RNA is independently selected from one or more of Tables 1-3, 4A-4E, 5A-5F, or 6A-6D.

In an embodiment, the targeting domain which is complementary with a target domain from the USH2A gene target position in the USH2A gene is 16 nucleotides or more in length. In an embodiment, the targeting domain is 16 nucleotides in length. In an embodiment, the targeting domain is 17 nucleotides in length. In other embodiments, the targeting domain is 18 nucleotides in length. In still other embodiments, the targeting domain is 19 nucleotides in length. In still other embodiments, the targeting domain is 20 nucleotides in length. In an embodiment, the targeting domain is 21 nucleotides in length. In an embodiment, the targeting domain is 22 nucleotides in length. In an embodiment, the targeting domain is 23 nucleotides in length. In an embodiment, the targeting domain is 24 nucleotides in length. In an embodiment, the targeting domain is 25 nucleotides in length. In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

A gRNA as described herein may comprise from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a gRNA comprises a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

A cleavage event, e.g., a double strand or single strand break, is generated by a Cas9 molecule. The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule).

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In this case, the eaCas9 molecule is an HNH-like domain nickase, e.g., the eaCas9 molecule comprises a mutation at D10, e.g., D10A. In other embodiments, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase, e.g., the eaCas9 molecule comprises a mutation at H840, e.g., H840A. In an embodiment, the eaCas9 molecule is an N-terminal RuvC-like domain nickase, e.g., the eaCas9 molecule comprises a mutation at H863, e.g., H863A.

In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In another aspect, disclosed herein is a nucleic acid, e.g., an isolated or non-naturally occurring nucleic acid, e.g., DNA, that comprises (a) a sequence that encodes a gRNA molecule comprising a targeting domain that is complementary with a target domain in USH2A gene as disclosed herein.

In an embodiment, the nucleic acid encodes a gRNA molecule, e.g., the first gRNA molecule, comprising a targeting domain comprising a sequence that is the same as, or differs by no more than 1, 2, 3, 4, or 5 nucleotides from, a targeting domain sequence from any one of Tables 1-3, 4A-4E, 5A-5F, or 6A-6D. In an embodiment, the nucleic acid encodes a gRNA molecule comprising a targeting domain that is selected from those in Tables 1-3, 4A-4E, 5A-5F, or 6A-6D.

In an embodiment, a nucleic acid encodes a gRNA comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, the nucleic acid encodes a gRNA molecule comprising a targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG) in the USH2A gene.

In an embodiment, the nucleic acid encodes a gRNA molecule comprising a targeting targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG). In an embodiment, the nucleic acid encodes a gRNA molecule comprising a targeting domain comprising a sequence that is the same as, or differs by no more than 1, 2, 3, 4, or 5 nucleotides from, a targeting domain sequence from Table 1. In an embodiment, the nucleic acid encodes a gRNA molecule comprising a targeting domain is selected from those in Table 1. For example, in certain embodiments, the targeting domain is

```
                                    (SEQ ID NO: 392)
GAGUGCAAAAAGAAGCCAA;

(SEQ ID NO: 393)
GUUAGAUGUCACCAAUUGUA;

(SEQ ID NO: 394)
GGUGUCACACUGAAGUCCUU;

(SEQ ID NO: 395)
GCCAUGGAGGUUACACUGGC;

(SEQ ID NO: 396)
GUCACAGGCCUUACAAU;

(SEQ ID NO: 397)
GUCACACUGAAGUCCUU;

(SEQ ID NO: 398)
UGCAAAAAGAAGCCAA;

(SEQ ID NO: 399)
UGCAGAGAAAACUUUUA;

(SEQ ID NO: 400)
UGUUCACUGAGCCAUGG;
or
                                    (SEQ ID NO: 401)
AUGGAGGUUACACUGGC.
```

In another embodiment, the nucleic acid encodes a gRNA molecule comprising a targeting domain comprising a sequence that is the same as, or differs by no more than 1, 2, 3, 4, or 5 nucleotides from, a targeting domain sequence from Table 2. In an embodiment, the targeting domain is selected from Table 2.

In another embodiment, the nucleic acid encodes a gRNA molecule comprising a targeting domain comprising a sequence that is the same as, or differs by no more than 1, 2, 3, 4, or 5 nucleotides from, a targeting domain sequence from Table 3. In an embodiment, the targeting domain is selected from Table 3.

In an embodiment, the targeting domain comprises a sequence that is the same as, or differs by no more than 1, 2, 3, 4, or 5 nucleotides from, a targeting domain sequence from Tables 4A-4E. In an embodiment, the targeting domain is selected from Tables 4A-4E.

In certain embodiments, the targeting domain is

```
                                    (SEQ ID NO: 402)
GCAAGCCCAAUGUUGAA;

(SEQ ID NO: 403)
GCAUUACAGACAGUCCC;

(SEQ ID NO: 397)
GUCACACUGAAGUCCUU;

(SEQ ID NO: 396)
GUCACAGGCCUUACAAU;

(SEQ ID NO: 406)
GUCUGUAAUGCUAAGAC;

(SEQ ID NO: 407)
GACACAGCUGGAUCCCUCCC;

(SEQ ID NO: 408)
GAGACAGUGCAAUAAAUGUU;

(SEQ ID NO: 409)
GCACUACACUGCCCAGAGUG;

(SEQ ID NO: 410)
GCACUGUCUCCCUUCAACAU;

(SEQ ID NO: 395)
GCCAUGGAGGUUACACUGGC;

(SEQ ID NO: 412)
GCCUGUGACUGUGACACAGC;

(SEQ ID NO: 394)
GGUGUCACACUGAAGUCCUU;
or
                                    (SEQ ID NO: 393)
GUUAGAUGUCACCAAUUGUA.
```

In another embodiment, the targeting domain comprises a sequence that is the same as, or differs by no more than 1, 2, 3, 4, or 5 nucleotides from, a targeting domain sequence from Tables 5A-5F. In an embodiment, the targeting domain is selected from Tables 5A-5F.

In certain embodiments, the targeting domain is

```
                                    (SEQ ID NO: 415)
GCACUACACUGCCCAGAGU;

(SEQ ID NO: 416)
GCCUGUGACUGUGACACAG;

(SEQ ID NO: 417)
GGCCUGUGACUGUGACACAG;

(SEQ ID NO: 418)
GGUGUGAUCAUUGCAAUU;

(SEQ ID NO: 419)
GACACCUGCAGAGAAAACUUUU;

(SEQ ID NO: 420)
GCAUUACAGACAGUCCCAGGG;
```

-continued

```
                                        (SEQ ID NO: 421)
GCUUAGGUGUGAUCAUUGCAAUU;

(SEQ ID NO: 422)
GCUUCUUUUUUGCACUACACUGCC;

(SEQ ID NO: 423)
GGCUUAGGUGUGAUCAUUGCAAUU;

(SEQ ID NO: 424)
GUAAGGCCUGUGACUGUGACACAG;
or (SEQ ID NO: 425)
GUGACACCUGCAGAGAAAACUUUU.
```

In yet another embodiment, the targeting domain comprises a sequence that is the same as, or differs by no more than 1, 2, 3, 4, or 5 nucleotides from, a targeting domain sequence from Tables 6A-6D. In an embodiment, the targeting domain is selected from Tables 6A-6D.

In certain embodiments, the targeting domain is

```
                                        (SEQ ID NO: 426)
GUGUCACACUGAAGUCC;

(SEQ ID NO: 427)
GGUGUGAUCAUUGCAAU;
or (SEQ ID NO: 428)
GGGCUCACAUCCAACAUCAU.
```

In an embodiment, the nucleic acid encodes a modular gRNA, e.g., one or more nucleic acids encode a modular gRNA. In other embodiments, the nucleic acid encodes a chimeric gRNA. The nucleic acid may encode a gRNA, e.g., the first gRNA molecule, comprising a targeting domain comprising 16 nucleotides or more in length. In one embodiment, the nucleic acid encodes a gRNA, e.g., the first gRNA molecule, comprising a targeting domain that is 16 nucleotides in length. In other embodiments, the nucleic acid encodes a gRNA, e.g., the first gRNA molecule, comprising a targeting domain that is 17 nucleotides in length. In still other embodiments, the nucleic acid encodes a gRNA, e.g., the first gRNA molecule, comprising a targeting domain that is 18 nucleotides in length. In still other embodiments, the nucleic acid encodes a gRNA, e.g., the first gRNA molecule, comprising a targeting domain that is 19 nucleotides in length. In still other embodiments, the nucleic acid encodes a gRNA, e.g., the first gRNA molecule, comprising a targeting domain that is 20 nucleotides in length. In still other embodiments, the nucleic acid encodes a gRNA, e.g., the first gRNA molecule, comprising a targeting domain that is 21 nucleotides in length. In still other embodiments, the nucleic acid encodes a gRNA, e.g., the first gRNA molecule, comprising a targeting domain that is 22 nucleotides in length. In still other embodiments, the nucleic acid encodes a gRNA, e.g., the first gRNA molecule, comprising a targeting domain that is 23 nucleotides in length. In still other embodiments, the nucleic acid encodes a gRNA, e.g., the first gRNA molecule, comprising a targeting domain that is 24 nucleotides in length. In still other embodiments, the nucleic acid encodes a gRNA, e.g., the first gRNA molecule, comprising a targeting domain that is 25 nucleotides in length. In still other embodiments, the nucleic acid encodes a gRNA, e.g., the first gRNA molecule, comprising a targeting domain that is 26 nucleotides in length.

In an embodiment, a nucleic acid encodes a gRNA comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a gRNA comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA comprising a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, a nucleic acid comprises (a) a sequence that encodes a gRNA molecule comprising a targeting domain that is complementary with a target domain in the USH2A gene as disclosed herein, and further comprising (b) a sequence that encodes a Cas9 molecule.

The Cas9 molecule may be a nickase molecule, a enzymatically activating Cas9 (eaCas9) molecule, e.g., an eaCas9 molecule that forms a double strand break in a target nucleic acid and an eaCas9 molecule forms a single strand break in a target nucleic acid. In an embodiment, a single strand break is formed in the strand of the target nucleic acid to which the targeting domain of said gRNA is complementary. In another embodiment, a single strand break is formed in the strand of the target nucleic acid other than the strand to which to which the targeting domain of said gRNA is complementary.

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In other embodiments, the said eaCas9 molecule is an HNH-like domain nickase, e.g., the eaCas9 molecule comprises a mutation at D10, e.g., D10A. In other embodiments, the eaCas9 molecule comprises N-terminal RuvC-like domain cleavage activity but has no, or no significant, HNH-like domain cleavage activity. In another embodiment, the eaCas9 molecule is an N-terminal RuvC-like domain nickase, e.g., the eaCas9 molecule comprises a mutation at H840, e.g., H840A. In another embodiment, the eaCas9 molecule is an N-terminal RuvC-like domain nickase, e.g., the eaCas9 molecule comprises a mutation at H863, e.g., H863A.

A nucleic acid disclosed herein may comprise (a) a sequence that encodes a gRNA molecule comprising a targeting domain that is complementary with a target domain in the USH2A gene as disclosed herein; and (b) a sequence that encodes a Cas9 molecule.

A nucleic acid disclosed herein may comprise (a) a sequence that encodes a gRNA molecule comprising a targeting domain that is complementary with a target domain in the USH2A gene as disclosed herein; (b) a sequence that encodes a Cas9 molecule; and further may comprises (c)(i) a sequence that encodes a second gRNA molecule described herein having a targeting domain that is complementary to a second target domain of the USH2A gene, and optionally, (c)(ii) a sequence that encodes a third gRNA molecule described herein having a targeting domain that is complementary to a third target domain of the USH2A gene; and optionally, (c)(iii) a sequence that encodes a fourth gRNA molecule described herein having a targeting domain that is complementary to a fourth target domain of the USH2A gene. In an embodiment, a nucleic acid encoding a second gRNA molecule comprising a targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG) in the USH2A gene.

In an embodiment, a nucleic acid encodes a second gRNA molecule comprising a targeting domain configured to provide a cleavage event, e.g., a double strand break or a single strand break, sufficiently close to the target position in the USH2A gene to allow alteration, either alone or in combination with the break positioned by the first gRNA molecule.

In an embodiment, a nucleic acid encodes a third gRNA molecule comprising a targeting domain configured to provide a cleavage event, e.g., a double strand break or a single strand break, sufficiently close to the target position in the USH2A gene to allow alteration, either alone or in combination with the break positioned by the first and/or second gRNA molecule.

In an embodiment, a nucleic acid encodes a fourth gRNA molecule comprising a targeting domain configured to provide a cleavage event, e.g., a double strand break or a single strand break, sufficiently close to the target position in the USH2A gene to allow alteration, either alone or in combination with the break positioned by the first gRNA molecule, the second gRNA molecule and/or the third gRNA molecule.

In an embodiment, a nucleic acid encodes a second gRNA molecule comprising a targeting domain configured to provide a cleavage event, e.g., a double strand break or a single strand break, in combination with the break position by said first gRNA molecule, sufficiently close to the target position in the USH2A gene to allow alteration of the target position, either alone or in combination with the break positioned by said first gRNA molecule.

In an embodiment, a nucleic acid encodes a third gRNA molecule comprising a targeting domain configured to provide a cleavage event, e.g., a double strand break or a single strand break, in combination with the break position by said first and/or second gRNA molecule, sufficiently close to the target position in the USH2A gene to allow alteration, either alone or in combination with the break positioned by the first and/or second gRNA molecule.

In an embodiment, a nucleic acid encodes a fourth gRNA molecule comprising a targeting domain configured to provide a cleavage event, e.g., a double strand break or a single strand break, in combination with the break positioned by the first gRNA molecule, the second gRNA molecule and/or the third gRNA molecule, sufficiently close to the target position in the USH2A gene to allow alteration, either alone or in combination with the break positioned by the first gRNA molecule, the second gRNA molecule and/or the third gRNA molecule.

In an embodiment, a nucleic acid encoding a second gRNA molecule comprising a targeting targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG). In an embodiment, the nucleic acid encodes a second gRNA molecule comprising a targeting domain comprising a sequence that is the same as, or differs by no more than 1, 2, 3, 4, or 5 amino acids from, a targeting domain sequence from Tables 1-3, 4A-4E, 5A-5F, or 6A-6D. In an embodiment, the nucleic acid encodes a second gRNA molecule comprising a targeting domain is selected from those in Tables 1-3, 4A-4E, 5A-5F, or 6A-6D. For example, in certain embodiments, the targeting domain is

```
                                (SEQ ID NO: 392)
            GAGUGCAAAAAAGAAGCCAA;

(SEQ ID NO: 393)
            GUUAGAUGUCACCAAUUGUA;

(SEQ ID NO: 394)
            GGUGUCACACUGAAGUCCUU;

(SEQ ID NO: 395)
            GCCAUGGAGGUUACACUGGC;

(SEQ ID NO: 396)
            GUCACAGGCCUUACAAU;

(SEQ ID NO: 397)
            GUCACACUGAAGUCCUU;

(SEQ ID NO: 398)
            UGCAAAAAAGAAGCCAA;

(SEQ ID NO: 399)
            UGCAGAGAAAACUUUUA;

(SEQ ID NO: 400)
            UGUUCACUGAGCCAUGG;
            or (SEQ ID NO: 401)
            AUGGAGGUUACACUGGC.
```

In certain embodiments, the targeting domain is

```
                                (SEQ ID NO: 402)
            GCAAGCCCAAUGUUGAA;

(SEQ ID NO: 403)
            GCAUUACAGACAGUCCC;

(SEQ ID NO: 397)
            GUCACACUGAAGUCCUU;

(SEQ ID NO: 396)
            GUCACAGGCCUUACAAU;

(SEQ ID NO: 406)
            GUCUGUAAUGCUAAGAC;

(SEQ ID NO: 407)
            GACACAGCUGGAUCCCUCCC;

(SEQ ID NO: 408)
            GAGACAGUGCAAUAAAUGUU;
```

```
                                     (SEQ ID NO: 409)
GCACUACACUGCCCAGAGUG;

(SEQ ID NO: 410)
GCACUGUCUCCCUUCAACAU;

(SEQ ID NO: 395)
GCCAUGGAGGUUACACUGGC;

(SEQ ID NO: 412)
GCCUGUGACUGUGACACAGC;

(SEQ ID NO: 394)
GGUGUCACACUGAAGUCCUU;
or (SEQ ID NO: 393)
GUUAGAUGUCACCAAUUGUA.
```

In certain embodiments, the targeting domain is

```
                                     (SEQ ID NO: 415)
GCACUACACUGCCCAGAGU;

(SEQ ID NO: 416)
GCCUGUGACUGUGACACAG;

(SEQ ID NO: 417)
GGCCUGUGACUGUGACACAG;

(SEQ ID NO: 418)
GGUGUGAUCAUUGCAAUU;

(SEQ ID NO: 419)
GACACCUGCAGAGAAAACUUUU;

(SEQ ID NO: 420)
GCAUUACAGACAGUCCCAGGG;

(SEQ ID NO: 421)
GCUUAGGUGUGAUCAUUGCAAUU;

(SEQ ID NO: 422)
GCUUCUUUUUUGCACUACACUGCC;

(SEQ ID NO: 423)
GGCUUAGGUGUGAUCAUUGCAAUU;

(SEQ ID NO: 424)
GUAAGGCCUGUGACUGUGACACAG;
or (SEQ ID NO: 425)
GUGACACCUGCAGAGAAAACUUUU.
```

In certain embodiments, the targeting domain is

```
                                     (SEQ ID NO: 426)
GUGUCACACUGAAGUCC;

(SEQ ID NO: 427)
GGUGUGAUCAUUGCAAU;
or (SEQ ID NO: 428)
GGGCUCACAUCCAACAUCAU.
```

In an embodiment, a nucleic acid encoding a third gRNA molecule comprising a targeting targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG). In an embodiment, the nucleic acid encodes a second gRNA molecule comprising a targeting domain comprising a sequence that is the same as, or differs by no more than 1, 2, 3, 4, or 5 amino acids from, a targeting domain sequence from Tables 1-3, 4A-4E, 5A-5F, or 6A-6D. In an embodiment, the nucleic acid encodes a third gRNA molecule comprising a targeting domain is selected from those in Tables 1-3, 4A-4E, 5A-5F, or 6A-6D. For example, in certain embodiments, the targeting domain is

```
                                     (SEQ ID NO: 392)
GAGUGCAAAAAAGAAGCCAA;

(SEQ ID NO: 393)
GUUAGAUGUCACCAAUUGUA;

(SEQ ID NO: 394)
GGUGUCACACUGAAGUCCUU;

(SEQ ID NO: 395)
GCCAUGGAGGUUACACUGGC;

(SEQ ID NO: 396)
GUCACAGGCCUUACAAU;

(SEQ ID NO: 397)
GUCACACUGAAGUCCUU;

(SEQ ID NO: 398)
UGCAAAAAAGAAGCCAA;

(SEQ ID NO: 399)
UGCAGAGAAACUUUUA;

(SEQ ID NO: 400)
UGUUCACUGAGCCAUGG;
or (SEQ ID NO: 401)
AUGGAGGUUACACUGGC.
```

In certain embodiments, the targeting domain is

```
                                     (SEQ ID NO: 402)
GCAAGCCCAAUGUUGAA;

(SEQ ID NO: 403)
GCAUUACAGACAGUCCC;

(SEQ ID NO: 397)
GUCACACUGAAGUCCUU;

(SEQ ID NO: 396)
GUCACAGGCCUUACAAU;

(SEQ ID NO: 406)
GUCUGUAAUGCUAAGAC;

(SEQ ID NO: 407)
GACACAGCUGGAUCCCUCCC;

(SEQ ID NO: 408)
GAGACAGUGCAAUAAAUGUU;

(SEQ ID NO: 409)
GCACUACACUGCCCAGAGUG;

(SEQ ID NO: 410)
GCACUGUCUCCCUUCAACAU;

(SEQ ID NO: 395)
GCCAUGGAGGUUACACUGGC;

(SEQ ID NO: 412)
GCCUGUGACUGUGACACAGC;

(SEQ ID NO: 394)
GGUGUCACACUGAAGUCCUU;
or
```

-continued (SEQ ID NO: 393)
GUUAGAUGUCACCAAUUGUA.

In certain embodiments, the targeting domain is (SEQ ID NO: 415)
GCACUACACUGCCCAGAGU;

(SEQ ID NO: 416)
GCCUGUGACUGUGACACAG;

(SEQ ID NO: 417)
GGCCUGUGACUGUGACACAG;

(SEQ ID NO: 418)
GGUGUGAUCAUUGCAAUU;

(SEQ ID NO: 419)
GACACCUGCAGAGAAAACUUUU;

(SEQ ID NO: 420)
GCAUUACAGACAGUCCCAGGG;

(SEQ ID NO: 421)
GCUUAGGUGUGAUCAUUGCAAUU;

(SEQ ID NO: 422)
GCUUCUUUUUUGCACUACACUGCC;

(SEQ ID NO: 423)
GGCUUAGGUGUGAUCAUUGCAAUU;

(SEQ ID NO: 424)
GUAAGGCCUGUGACUGUGACACAG;
or (SEQ ID NO: 425)
GUGACACCUGCAGAGAAAACUUUU.

In certain embodiments, the targeting domain is (SEQ ID NO: 426)
GUGUCACACUGAAGUCC;

(SEQ ID NO: 427)
GGUGUGAUCAUUGCAAU;
or (SEQ ID NO: 428)
GGGCUCACAUCCAACAUCAU.

In an embodiment, a nucleic acid encoding a fourth gRNA molecule comprising a targeting targeting domain is configured to provide a cleavage event, e.g., a double strand break or a single strand break, within 10, 25, 50, 75, 100, 125, 150, 175, 200, 225, 250, or 300 nucleotides of a target position in the USH2A gene, e.g., a deletion of guanine at nucleotide positon 2299 (2299delG). In an embodiment, the nucleic acid encodes a fourth gRNA molecule comprising a targeting domain comprising a sequence that is the same as, or differs by no more than 1, 2, 3, 4, or 5 amino acids from, a targeting domain sequence from Tables 1-3, 4A-4E, 5A-5F, or 6A-6D. In an embodiment, the nucleic acid encodes a second gRNA molecule comprising a targeting domain is selected from those in Tables 1-3, 4A-4E, 5A-5F, or 6A-6D. For example, in certain embodiments, the targeting domain is (SEQ ID NO: 392)
GAGUGCAAAAAGAAGCCAA;

(SEQ ID NO: 393)
GUUAGAUGUCACCAAUUGUA;

(SEQ ID NO: 394)
GGUGUCACACUGAAGUCCUU;

(SEQ ID NO: 395)
GCCAUGGAGGUUACACUGGC;

(SEQ ID NO: 396)
GUCACAGGCCUUACAAU;

(SEQ ID NO: 397)
GUCACACUGAAGUCCUU;

(SEQ ID NO: 398)
UGCAAAAAGAAGCCAA;

(SEQ ID NO: 399)
UGCAGAGAAAACUUUUA;

(SEQ ID NO: 400)
UGUUCACUGAGCCAUGG;
or (SEQ ID NO: 401)
AUGGAGGUUACACUGGC.

In certain embodiments, the targeting domain is (SEQ ID NO: 402)
GCAAGCCCAAUGUUGAA;

(SEQ ID NO: 403)
GCAUUACAGACAGUCCC;

(SEQ ID NO: 397)
GUCACACUGAAGUCCUU;

(SEQ ID NO: 396)
GUCACAGGCCUUACAAU;

(SEQ ID NO: 406)
GUCUGUAAUGCUAAGAC;

(SEQ ID NO: 407)
GACACAGCUGGAUCCCUCCC;

(SEQ ID NO: 408)
GAGACAGUGCAAUAAAUGUU;

(SEQ ID NO: 409)
GCACUACACUGCCCAGAGUG;

(SEQ ID NO: 410)
GCACUGUCUCCCUUCAACAU;

(SEQ ID NO: 395)
GCCAUGGAGGUUACACUGGC;

(SEQ ID NO: 412)
GCCUGUGACUGUGACACAGC;

(SEQ ID NO: 394)
GGUGUCACACUGAAGUCCUU;
or (SEQ ID NO: 393)
GUUAGAUGUCACCAAUUGUA.

In certain embodiments, the targeting domain is (SEQ ID NO: 415)
GCACUACACUGCCCAGAGU;

(SEQ ID NO: 416)
GCCUGUGACUGUGACACAG;

-continued

GGCCUGUGACUGUGACACAG; (SEQ ID NO: 417)

GGUGUGAUCAUUGCAAUU; (SEQ ID NO: 418)

GACACCUGCAGAGAAAACUUUU; (SEQ ID NO: 419)

GCAUUACAGACAGUCCCAGGG; (SEQ ID NO: 420)

GCUUAGGUGUGAUCAUUGCAAUU; (SEQ ID NO: 421)

GCUUCUUUUUUGCACUACACUGCC; (SEQ ID NO: 422)

GGCUUAGGUGUGAUCAUUGCAAUU; (SEQ ID NO: 423)

GUAAGGCCUGUGACUGUGACACAG; (SEQ ID NO: 424)
or

GUGACACCUGCAGAGAAAACUUUU. (SEQ ID NO: 425)

In certain embodiments, the targeting domain is

GUGUCACACUGAAGUCC; (SEQ ID NO: 426)

GGUGUGAUCAUUGCAAU; (SEQ ID NO: 427)
or

GGGCUCACAUCCAACAUCAU. (SEQ ID NO: 428)

In another embodiment, the nucleic acid encodes a second gRNA molecule comprising a targeting domain comprising a sequence that is the same as, or differs by no more than 1, 2, 3, 4, or 5 nucleotides from, a targeting domain sequence from Table 1. In an embodiment, the targeting domain is selected from Table 1. In another embodiment, the nucleic acid encodes a third gRNA molecule comprising a targeting domain comprising a sequence that is the same as, or differs by no more than 1, 2, 3, 4, or 5 nucleotides from, a targeting domain sequence from Table 1. In an embodiment, the targeting domain is selected from Table 1. In another embodiment, the nucleic acid encodes a fourth gRNA molecule comprising a targeting domain comprising a sequence that is the same as, or differs by no more than 1, 2, 3, 4, or 5 nucleotides from, a targeting domain sequence from Table 1. In an embodiment, the targeting domain is selected from Table 1.

In another embodiment, the nucleic acid encodes a second gRNA molecule comprising a targeting domain comprising a sequence that is the same as, or differs by no more than 1, 2, 3, 4, or 5 nucleotides from, a targeting domain sequence from Table 2. In an embodiment, the targeting domain is selected from Table 2. In another embodiment, the nucleic acid encodes a third gRNA molecule comprising a targeting domain comprising a sequence that is the same as, or differs by no more than 1, 2, 3, 4, or 5 nucleotides from, a targeting domain sequence from Table 2. In an embodiment, the targeting domain is selected from Table 2. In another embodiment, the nucleic acid encodes a fourth gRNA molecule comprising a targeting domain comprising a sequence that is the same as, or differs by no more than 1, 2, 3, 4, or 5 nucleotides from, a targeting domain sequence from Table 2. In an embodiment, the targeting domain is selected from Table 2.

In another embodiment, the nucleic acid encodes a second gRNA molecule comprising a targeting domain comprising a sequence that is the same as, or differs by no more than 1, 2, 3, 4, or 5 nucleotides from, a targeting domain sequence from Table 3. In an embodiment, the targeting domain is selected from Table 3. In another embodiment, the nucleic acid encodes a third gRNA molecule comprising a targeting domain comprising a sequence that is the same as, or differs by no more than 1, 2, 3, 4, or 5 nucleotides from, a targeting domain sequence from Table 3. In an embodiment, the targeting domain is selected from Table 3. In another embodiment, the nucleic acid encodes a fourth gRNA molecule comprising a targeting domain comprising a sequence that is the same as, or differs by no more than 1, 2, 3, 4, or 5 nucleotides from, a targeting domain sequence from Table 3. In an embodiment, the targeting domain is selected from Table 3.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from Tables 4A-4E. In an embodiment, the targeting domain is selected from Tables 4A-4E. In another embodiment, the nucleic acid encodes a third gRNA molecule comprising a targeting domain comprising a sequence that is the same as, or differs by no more than 1, 2, 3, 4, or 5 nucleotides from, a targeting domain sequence from Tables 4A-4E. In an embodiment, the targeting domain is selected from Tables 4A-4E. In yet another embodiment, the nucleic acid encodes a fourth gRNA molecule comprising a targeting domain comprising a sequence that is the same as, or differs by no more than 1, 2, 3, 4, or 5 nucleotides from, a targeting domain sequence from Tables 4A-4E. In an embodiment, the targeting domain is selected from Tables 4A-4E.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from Tables 5A-5F. In an embodiment, the targeting domain is selected from Tables 5A-5F. In another embodiment, the nucleic acid encodes a third gRNA molecule comprising a targeting domain comprising a sequence that is the same as, or differs by no more than 1, 2, 3, 4, or 5 nucleotides from, a targeting domain sequence from Tables 5A-5F. In an embodiment, the targeting domain is selected from Tables 5A-5F. In yet another embodiment, the nucleic acid encodes a third gRNA molecule comprising a targeting domain comprising a sequence that is the same as, or differs by no more than 1, 2, 3, 4, or 5 nucleotides from, a targeting domain sequence from Tables 5A-5F. In an embodiment, the targeting domain is selected from Tables 5A-5F.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from Tables 6A-6D. In an embodiment, the targeting domain is selected from Tables 6A-6D. In another embodiment, the nucleic acid encodes a second gRNA molecule comprising a targeting domain comprising a sequence that is the same as, or differs by no more than 1, 2, 3, 4, or 5 nucleotides from, a targeting domain sequence from Tables 6A-6D. In an embodiment, the targeting domain is selected from Tables 6A-6D. In yet another embodiment, the nucleic acid encodes a second gRNA molecule comprising a targeting domain comprising a sequence that is the same as, or differs by no more than 1, 2, 3, 4, or 5 nucleotides from, a targeting domain sequence from Tables 6A-6D. In an embodiment, the targeting domain is selected from Tables 6A-6D.

In an embodiment, the nucleic acid encodes a second gRNA which is a modular gRNA, e.g., wherein one or more nucleic acid molecules encode a modular gRNA. In another embodiment, the nucleic acid encoding a second gRNA is a chimeric gRNA. In yet another embodiment, when a nucleic acid encodes a third or fourth gRNA, the third and fourth gRNA may be a modular gRNA or a chimeric gRNA. When multiple gRNAs are used, any combination of modular or chimeric gRNAs may be used.

A nucleic acid may encode a second, a third, and/or a fourth gRNA, each independently, comprising a targeting domain comprising 16 nucleotides or more in length. In an embodiment, the nucleic acid encodes a second gRNA comprising a targeting domain that is 16 nucleotides in length. In an embodiment, the nucleic acid encodes a second gRNA comprising a targeting domain that is 17 nucleotides in length. In other embodiments, the nucleic acid encodes a second gRNA comprising a targeting domain that is 18 nucleotides in length. In still other embodiments, the nucleic acid encodes a second gRNA comprising a targeting domain that is 19 nucleotides in length. In still other embodiments, the nucleic acid encodes a second gRNA comprising a targeting domain that is 20 nucleotides in length. In still other embodiments, the nucleic acid encodes a second gRNA comprising a targeting domain that is 21 nucleotides in length. In still other embodiments, the nucleic acid encodes a second gRNA comprising a targeting domain that is 22 nucleotides in length. In still other embodiments, the nucleic acid encodes a second gRNA comprising a targeting domain that is 23 nucleotides in length. In still other embodiments, the nucleic acid encodes a second gRNA comprising a targeting domain that is 24 nucleotides in length. In still other embodiments, the nucleic acid encodes a second gRNA comprising a targeting domain that is 25 nucleotides in length. In still other embodiments, the nucleic acid encodes a second gRNA comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a second, a third, and/or a fourth gRNA, each independently, comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a second gRNA comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a second gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a second gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a second gRNA comprising a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In some embodiments, the nucleic acid encodes (a) a sequence that encodes a gRNA molecule comprising a targeting domain that is complementary with a target domain in the USH2A gene as disclosed herein; (b) a sequence that encodes a Cas9 molecule; and further comprises (c)(i) a sequence that encodes a second gRNA molecule described herein having a targeting domain that is complementary to a second target domain of the USH2A gene, and optionally, (c)(ii) a sequence that encodes a third gRNA molecule described herein having a targeting domain that is complementary to a third target domain of the USH2A gene; and optionally, (c)(iii) a sequence that encodes a fourth gRNA molecule described herein having a targeting domain that is complementary to a fourth target domain of the USH2A gene. In some embodiments, the targeting domain of the gRNA molecule and the targeting domain of the second gRNA molecules are complementary to opposite strands of the target nucleic acid molecule. In some embodiments, the gRNA molecule and the second gRNA molecule are configured such that the PAMs are oriented outward.

In some embodiments, the gRNA molecule and said second gRNA molecule are configured such that they do not overlap and are separated by as much as 50, 100, or 200 nucleotides. The gRNA and second gRNA may be configured such that single strand breaks are formed on each strand of the target nucleic acid. In an embodiment, the gRNA and the second gRNA are configured such that single strand breaks are formed on each strand of the target nucleic acid and the single strand beaks are within 50-100 nucleotides of one another.

In an embodiment, the gRNA molecule and the second gRNA molecule are configured such that the first and second breaks are 5' to a target position in the USH2A gene, e.g., a deletion of guanine at nucleotide positon 2299 (2299delG). In another embodiment, the gRNA molecule and the second gRNA molecule are configured such that the first and second breaks are 3' to a target position in the USH2A gene, e.g., a deletion of guanine at nucleotide positon 2299 (2299delG). In another embodiment, the gRNA molecule and said second gRNA molecule are configured such that the first and second breaks flank a target position in the USH2A gene, e.g., a deletion of guanine at nucleotide positon 2299 (2299delG).

In some embodiments, the nucleic acid encodes (a) a sequence that encodes a gRNA molecule comprising a targeting domain that is complementary with a target domain in the USH2A gene as disclosed herein; (b) a sequence that encodes a Cas9 molecule; (c) a sequence that encodes a second, third and/or fourth gRNA molecule described herein having a targeting domain that is complementary to a second target domain of the USH2A gene; and further comprising (d) a template nucleic acid. In an embodiment, the template nucleic acid is a single stranded nucleic acid. In another embodiment, the template nucleic acid is a double stranded nucleic acid. In some embodiments, the template nucleic acid comprises a nucleotide sequence, e.g., of one or more nucleotides, that will be added to or will template a change in the target nucleic acid. In other embodiments, the template nucleic acid comprises a nucleotide sequence that may be used to modify the target position. In other embodiments, the template nucleic acid comprises a nucleotide sequence, e.g., of one or more nucleotides, that corresponds to wild-type sequence of the target nucleic acid, e.g., of the target position.

The template nucleic acid may comprise a replacement sequence, e.g., a replacement sequence from the Table 13. In some embodiments, the template nucleic acid comprises a 5' homology arm, e.g., a 5' homology arm from Table 13. In other embodiments, the template nucleic acid comprises a 3' homology arm, e.g., a 3' homology arm from Table 13.

As described above, a nucleic acid may comprise (a) a sequence encoding a gRNA molecule comprising a targeting domain that is complementary with a target domain in USH2A gene, and (b) a sequence encoding a Cas9 molecule. In some embodiments, (a) and (b) are present on the same nucleic acid molecule, e.g., the same vector, e.g., the same viral vector, e.g., the same adeno-associated virus (AAV) vector. In an embodiment, the nucleic acid molecule is an AAV vector.

In other embodiments, (a) is present on a first nucleic acid molecule, e.g. a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors.

In other embodiments, the nucleic acid may further comprise (c) a sequence that encodes a second, third and/or fourth gRNA molecule as described herein. In some embodiments, the nucleic acid comprises (a), (b) and (c), but not (d), a template nucleic acid. Each of (a) and (c) may be present on the same nucleic acid molecule, e.g., the same vector, e.g., the same viral vector, e.g., the same adeno-associated virus (AAV) vector. In an embodiment, the nucleic acid molecule is an AAV vector.

In other embodiment, (a) and (c) are on different vectors. For example, (a) may be present on a first nucleic acid molecule, e.g. a first vector, e.g., a first viral vector, e.g., a first AAV vector; and (c) may be present on a second nucleic acid molecule, e.g., a second vector, e.g., a second vector, e.g., a second AAV vector. In an embodiment, the first and second nucleic acid molecules are AAV vectors.

In another embodiment, each of (a), (b), and (c) are present on the same nucleic acid molecule, e.g., the same vector, e.g., the same viral vector, e.g., an AAV vector. In an embodiment, the nucleic acid molecule is an AAV vector. In an alternate embodiment, one of (a), (b), and (c) is encoded on a first nucleic acid molecule, e.g., a first vector, e.g., a first viral vector, e.g., a first AAV vector; and a second and third of (a), (b), and (c) is encoded on a second nucleic acid molecule, e.g., a second vector, e.g., a second vector, e.g., a second AAV vector. The first and second nucleic acid molecule may be AAV vectors.

In an embodiment, (a) is present on a first nucleic acid molecule, e.g., a first vector, e.g., a first viral vector, a first AAV vector; and (b) and (c) are present on a second nucleic acid molecule, e.g., a second vector, e.g., a second vector, e.g., a second AAV vector. The first and second nucleic acid molecule may be AAV vectors.

In other embodiments, (b) is present on a first nucleic acid molecule, e.g., a first vector, e.g., a first viral vector, e.g., a first AAV vector; and (a) and (c) are present on a second nucleic acid molecule, e.g., a second vector, e.g., a second vector, e.g., a second AAV vector. The first and second nucleic acid molecule may be AAV vectors.

In other embodiments, (c) is present on a first nucleic acid molecule, e.g., a first vector, e.g., a first viral vector, e.g, a first AAV vector; and (a) and (b) are present on a second nucleic acid molecule, e.g., a second vector, e.g., a second vector, e.g., a second AAV vector. The first and second nucleic acid molecule may be AAV vectors.

In another embodiment, each of (a), (b), (c) and (d) are present on the same nucleic acid molecule, e.g., the same vector, e.g., the same viral vector, e.g., an AAV vector. In an embodiment, the nucleic acid molecule may be an AAV vector.

In other embodiments, one of (a), (b), (c) and (d) is encoded on a first nucleic acid molecule, e.g., a first vector, e.g., a first viral vector, e.g., a first AAV vector; and a second, third, and fourth of (a), (b), (c) and (d) is encoded on a second nucleic acid molecule, e.g., a second vector, e.g., a second vector, e.g., a second AAV vector. The first and second nucleic acid molecule may be AAV vectors.

In other embodiments, (a) is present on a first nucleic acid molecule, e.g., a first vector, e.g., a first viral vector, e.g., a first AAV vector; and (b), (c), and (d) are present on a second nucleic acid molecule, e.g., a second vector, e.g., a second vector, e.g., a second AAV vector.

The first and second nucleic acid molecule may be AAV vectors.

In other embodiments, (b) is present on a first nucleic acid molecule, e.g., a first vector, e.g., a first viral vector, e.g., a first AAV vector; and (a), (c), and (d) are present on a second nucleic acid molecule, e.g., a second vector, e.g., a second vector, e.g., a second AAV vector. The first and second nucleic acid molecule may be AAV vectors.

In other embodiments, (c) is present on a first nucleic acid molecule, e.g., a first vector, e.g., a first viral vector, e.g., a first AAV vector; and (a), (b), and (d) are present on a second nucleic acid molecule, e.g., a second vector, e.g., a second vector, e.g., a second vector, e.g., a second AAV vector. The first and second nucleic acid molecule may be AAV vectors.

In other embodiments, (d) is present on a first nucleic acid molecule, e.g., a first vector, e.g., a first viral vector, e.g., a first AAV vector; and (a), (b), and (c) are present on a second nucleic acid molecule, e.g., a second vector, e.g., a second vector, e.g., a second AAV vector. The first and second nucleic acid molecule may be AAV vectors.

In other embodiments, a first and second of (a), (b), (c) and (d) is encoded on a first nucleic acid molecule, e.g., a first vector, e.g., a first viral vector, e.g., a first viral vector, e.g., a first AAV vector; and a third and fourth of (a), (b), (c) and (d) is encoded on a second nucleic acid molecule, e.g., a second vector, e.g., a second vector, e.g., a second vector, e.g., a second AAV vector. The first and second nucleic acid molecule may be AAV vectors.

In other embodiments, (a) and (b) are present on a first nucleic acid molecule, e.g., a first vector, e.g., a first viral vector, e.g., a first AAV vector; and (c) and (d) are present on a second nucleic acid molecule, e.g., a second vector, e.g., a second vector, e.g., a second vector, e.g., a second AAV vector. The first and second nucleic acid molecule may be AAV vectors.

In other embodiments, (a) and (c) are present on a first nucleic acid molecule, e.g., a first vector, e.g., a first viral vector, e.g., a first AAV vector; and (b) and (d) are present on a second nucleic acid molecule, e.g., a second vector, e.g., a second vector, e.g., a second vector, e.g., a second AAV vector. The first and second nucleic acid molecule may be AAV vectors.

In other embodiments, (a) and (d) are present on a first nucleic acid molecule, e.g., a first vector, e.g., a first viral vector, e.g., a first AAV vector; and (b) and (c) are present on a second nucleic acid molecule, e.g., a second vector, e.g., a second vector, e.g., a second vector, e.g., a second AAV vector. The first and second nucleic acid molecule may be AAV vectors.

In other embodiments, (b) and (d) are present on a first nucleic acid molecule, e.g., a first vector, e.g., a first viral vector, e.g., a first AAV vector; and (a) and (c) are present on a second nucleic acid molecule, e.g., a second vector, e.g., a second vector, e.g., a second vector, e.g., a second AAV vector. The first and second nucleic acid molecule may be AAV vectors.

In other embodiments, the first nucleic acid molecule is other than an AAV vector and the second nucleic acid molecule is an AAV vector. In still other embodiments, the first nucleic acid molecule is an AAV vector and the second nucleic acid molecule is other than an AAV vector.

The nucleic acids described herein may comprise a promoter operably linked to the sequence that encodes said gRNA molecule of (a), e.g., a promoter described herein. The nucleic acid may further comprise a second promoter operably linked to the sequence that encodes the second gRNA molecule of (c), e.g., a promoter described herein. The promoter and second promoter differ from one another. In some embodiments, the promoter and second promoter are the same.

The nucleic acids described herein may further comprise a promoter operably linked to the sequence that encodes the Cas9 molecule of (b), e.g., a promoter described herein.

In another aspect, disclosed herein is a composition comprising (a) a gRNA molecule comprising a targeting domain that is complementary with a target domain in USH2A gene, as described herein. The composition of (a) may further comprise (b) a Cas9 molecule, e.g., a Cas9 molecule as described herein. A composition of (a) and (b) may further comprise (c) a second gRNA molecule, e.g., a second, third and/or fourth gRNA molecule, e.g., a second, third and/or fourth gRNA molecule, as described herein. A composition of (a), (b) and (c) may further comprise (d) a template nucleic acid, e.g., a template nucleic acid described herein, e.g., a template nucleic acid, as described herein. In an embodiment, the composition is a pharmaceutical composition. The Compositions described herein, e.g., pharmaceutical compositions described herein, can be used in treating Usher Syndrome or retinitis pigmentosa 39 in a subject, e.g., in accordance with a method disclosed herein.

In another aspect, disclosed herein is a method of altering a cell, e.g., altering the structure, e.g., altering the sequence, of a target nucleic acid of a cell, comprising contacting said cell with: (a) a gRNA that targets the USH2A gene, e.g., a gRNA as described herein; (b) a Cas9 molecule, e.g., a Cas9 molecule as described herein; and optionally, (c) a second, third and/or fourth gRNA that targets USH2A gene, e.g., a second, third and/or fourth gRNA as described herein; and (d) a template nucleic acid, e.g., a template nucleic acid as described herein.

In some embodiments, the method comprises contacting said cell with (a), (b), (c), and (d). The gRNA of (a) may be selected from any of Tables 1-3, 4A-4E, 5A-5F, or 6A-6D, or a gRNA that differs by no more than 1, 2, 3, 4, or 5 nucleotides from, a targeting domain sequence from any of Tables 1-3, 4A-4E, 5A-5F, or 6A-6D. The gRNA of (c) may be selected from any of Tables 1-3, 4A-4E, 5A-5F, or 6A-6D, or a gRNA that differs by no more than 1, 2, 3, 4, or 5 nucleotides from, a targeting domain sequence from any of Tables 1-3, 4A-4E, 5A-5F, or 6A-6D.

In some embodiments, the method comprises contacting a cell from a subject. The cell may be from a subject having a mutation in the USH2A gene, e.g., a deletion of guanine at nucleotide positon 2299 (2299delG) in the USH2A gene. In an embodiment, the cell is from a subject suffering from Usher syndrome, e.g., Usher syndrome type 2A. In another embodiment, the cell is from a subject suffering from retinitis pigmentosa, e.g., retinitis pigmentosa 39.

In some embodiments, the cell being contacted in the disclosed method is a photoreceptor cell. The contacting may be performed ex vivo and the contacted cell may be returned to the subject's body after the contacting step. In other embodiments, the contacting step may be performed in vivo.

In some embodiments, the cell being contacted in the disclosed method is an inner hair cell or an outer hair cell. The contacting may be performed ex vivo and the contacted cell may be returned to the subject's body after the contacting step. In other embodiments, the contacting step may be performed in vivo.

In some embodiments, the method of altering a cell as described herein comprises acquiring knowledge of a mutation in the USH2A gene, e.g., a deletion of guanine at nucleotide positon 2299 (2299delG) in said cell, prior to the contacting step. Acquiring knowledge of the presence of a mutation in the USH2A gene, e.g., a deletion of guanine at nucleotide positon 2299 (2299delG) in the cell may be by sequencing a portion of the USH2A (or RP39) gene. In some embodiments, acquiring knowledge of a mutation in the USH2A (or RP39) gene is used to treat a subject (or a cell from the subject) likely to develop Usher syndrome or retinitis pigmentosa (e.g., correct the guanine deletion at nucleotide position 2299).

Based on the presence of a mutation in the USH2A gene, e.g., a deletion of guanine at nucleotide positon 2299 (2299delG), the method may further comprise selecting a template nucleic, e.g., to correct the mutation in the cell. For example, the method may comprise correcting a guanine deletion at nucleotide position 2299 in the USH2A gene.

In some embodiments, the contacting step of the method comprises contacting the cell with a nucleic acid, e.g., a vector, e.g., an AAV vector, that expresses at least one of (a), (b), and (c). In some embodiments, the contacting step of the method comprises contacting the cell with a nucleic acid, e.g., a vector, e.g., an AAV vector, that expresses each of (a), (b), and (c). In another embodiment, the contacting step of the method comprises delivering to the cell the Cas9 molecule of (b) and a nucleic acid which encodes a gRNA of (a) and optionally, a second, third and/or fourth gRNA of (c).

In an embodiment, the contacting step comprises contacting the cell with a nucleic acid, e.g., a vector, e.g., an AAV vector, described herein.

In an embodiment, the contacting step comprises delivering to the cell the Cas9 molecule of (b), as a protein or an mRNA, and a nucleic acid which encodes a gRNA of (a) and optionally a second, third and/or fourth gRNA of (c).

In an embodiment, the contacting step comprises delivering to the cell the Cas9 molecule of (b), as a protein or an mRNA, said gRNA of (a), as an RNA, and optionally said second, third and/or fourth gRNA of (c), as an RNA.

In an embodiment, the contacting step comprises delivering to the cell the gRNA of (a) as an RNA, optionally the second, third and/or fourth gRNA of (c) as an RNA, and a nucleic acid that encodes the Cas9 molecule of (b).

In another aspect, disclosed herein is a method of treating a subject having or likely to develop Usher Syndrome, e.g., by altering the structure, e.g., the sequence, of a target nucleic acid of the subject, comprising contacting said subject (or a cell from said subject) with:

(a) a gRNA that targets the USH2A gene, e.g., a gRNA disclosed herein;

(b) a Cas9 molecule, e.g., a Cas9 molecule disclosed herein;

optionally, (c)(i) a second gRNA that targets USH2A gene, e.g., a second gRNA disclosed herein; and further optionally, (c)(ii) a third gRNA, and still further optionally, (c)(iii) a fourth gRNA that target the CEP290, e.g., a fourth gRNA disclosed herein, and (d) a template nucleic acid, e.g., a template nucleic acid disclosed herein.

In an embodiment, contacting comprises contacting with (a), (b), and (d).

In an embodiment, contacting comprises contacting with (a), (b), (c)(i), and (d).

In an embodiment, contacting comprises contacting with (a), (b), (c)(i), (c)(ii), and (d).

In an embodiment, contacting comprises contacting with (a), (b), (c)(i), (c)(ii), (c)(iii), and (d).

The gRNA of (a) or (c) (e.g., (c)(i), (c)(ii), or (c)(iii)) may be independently selected from any of Tables 1-3, 4A-4E, 5A-5F, or 6A-6D, or a gRNA that differs by no more than 1, 2, 3, 4, or 5 nucleotides from, a targeting domain sequence from any of Tables 1-3, 4A-4E, 5A-5F, or 6A-6D.

In an embodiment, said subject is suffering from Usher syndrome. In an embodiment, said subject has a mutation in the USH2A gene, e.g., a deletion of guanine at nucleotide positon 2299 (2299delG) in the USH2A gene.

In an embodiment, the method comprises acquiring knowledge of the presence of a mutation in the USH2A gene, e.g., a deletion of guanine at nucleotide positon 2299 (2299delG) in the USH2A gene, in said subject.

In an embodiment, the method comprises acquiring knowledge of the presence of a mutation in the USH2A gene, e.g., a deletion of guanine at nucleotide positon 2299 (2299delG) in the USH2A gene, in said subject by sequencing a portion of the USH2A gene.

In an embodiment, a cell of said subject is contacted ex vivo with (a), (b), (d), and optionally (c)(i), further optionally (c)(ii), and still further optionally (c)(iii). In an embodiment, said cell is returned to the subject's body.

In an embodiment, the method comprises a treatment comprising introducing a cell into said subject's body, wherein said cell subject was contacted ex vivo with (a), (b), (d), and optionally (c)(i), further optionally (c)(ii), and still further optionally (c)(iii).

In an embodiment, the method comprises said contacting, e.g., contacting a cell of the subject, is performed in vivo. In an embodiment, contacting the cell of a subject in vivo is by subretinal delivery. In an embodiment, contacting the cell of a subject in vivo is by subretinal injection.

In an embodiment, the contacting step comprises contacting said subject with a nucleic acid, e.g., a vector, e.g., an AAV vector, described herein, e.g., a nucleic acid that expresses at least one of (a), (b), (c)(i), (c)(ii), or (c)(iii).

In an embodiment, the contacting step comprises delivering to said subject said Cas9 molecule of (b), as a protein or mRNA, and a nucleic acid which encodes (a), and optionally (c)(i), further optionally (c)(ii), and still further optionally (c)(iii).

In an embodiment, the contacting step comprises delivering to said subject said Cas9 molecule of (b), as a protein or mRNA, said gRNA of (a), as an RNA, and optionally said second gRNA of (c)(i), further optionally said third gRNA of (c)(ii), and still further optionally said fourth gRNA of (c)(iii), as an RNA.

In an embodiment, the contacting step comprises delivering to said subject said gRNA of (a), as an RNA, optionally said second gRNA of (c)(i), further optionally said third gRNA of (c)(ii), and still further optionally said fourth gRNA of (c)(iii), as an RNA, and a nucleic acid that encodes the Cas9 molecule of (b).

In another aspect, disclosed herein is a method of treating a subject having or likely to develop retinitis pigmentosa, e.g., by altering the structure, e.g., the sequence, of a target nucleic acid of the subject, comprising contacting said subject (or a cell from said subject) with:

(a) a gRNA that targets the RP39 (also known as USH2A) gene, e.g., a gRNA disclosed herein;

(b) a Cas9 molecule, e.g., a Cas9 molecule disclosed herein;

optionally, (c)(i) a second gRNA that targets USH2A gene, e.g., a second gRNA disclosed herein; and further optionally, (c)(ii) a third gRNA, and still further optionally, (c)(iii) a fourth gRNA that target the CEP290, e.g., a third and fourth gRNA disclosed herein, and (d) a template nucleic acid, e.g., a template nucleic acid disclosed herein.

In an embodiment, contacting comprises contacting with (a), (b), and (d).

In an embodiment, contacting comprises contacting with (a), (b), (c)(i), and (d).

In an embodiment, contacting comprises contacting with (a), (b), (c)(i), (c)(ii), and (d).

In an embodiment, contacting comprises contacting with (a), (b), (c)(i), (c)(ii), (c)(iii), and (d).

The gRNA of (a) may be selected from any of Tables 1-3, 4A-4E, 5A-5F, or 6A-6D, or a gRNA that differs by no more than 1, 2, 3, 4, or 5 nucleotides from, a targeting domain sequence from any of Tables 1-3, 4A-4E, 5A-5F, or 6A-6D.

The gRNA of (c) may be selected from any of Tables 1-3, 4A-4E, 5A-5F, or 6A-6D, or a gRNA that differs by no more than 1, 2, 3, 4, or 5 nucleotides from, a targeting domain sequence from any of Tables 1-3, 4A-4E, 5A-5F, or 6A-6D.

In an embodiment, said subject is suffering from Usher syndrome or retinitis pigmentosa. In an embodiment, said subject has a mutation in the USH2A gene, e.g., a deletion of guanine at nucleotide positon 2299 (2299delG) in the USH2A gene.

In an embodiment, the method comprises acquiring knowledge of the presence of a mutation in the USH2A gene, e.g., a deletion of guanine at nucleotide positon 2299 (2299delG) in the USH2A gene, in said subject.

In an embodiment, the method comprises acquiring knowledge of the presence of a mutation in the USH2A gene, e.g., a deletion of guanine at nucleotide positon 2299 (2299delG) in the USH2A gene, in said subject by sequencing a portion of the USH2A gene.

In an embodiment, said subject is suffering from retinitis pigmentosa, e.g., retinitis pigmentosa 39. In an embodiment, said subject has a mutation in the RP39 (also known as USH2A) gene, e.g., a deletion of guanine at nucleotide positon 2299 (2299delG) in the RP39 gene.

In an embodiment, the method comprises acquiring knowledge of the presence of a mutation in the RP39 gene, e.g., a deletion of guanine at nucleotide positon 2299 (2299delG) in the RP39 gene, in said subject.

In an embodiment, the method comprises acquiring knowledge of the presence of a mutation in the RP39 gene, e.g., a deletion of guanine at nucleotide positon 2299 (2299delG) in the RP39 gene, in said subject by sequencing a portion of the USH2A gene.

In an embodiment, the method comprises, based on the presence of a mutation in the USH2A (or RP39) gene, e.g., a deletion of guanine at nucleotide positon 2299 (2299delG), selecting a template nucleic acid.

In an embodiment, the method comprises correcting a deletion of a guanine at nucleotide positon 2299 (2299delG) in the USH2A (or RP39) gene.

In an embodiment, a cell of said subject is contacted ex vivo with (a), (b), (d), and optionally (c)(i), further optionally (c)(ii), and still further optionally (c)(iii). In an embodiment, said cell is returned to the subject's body.

In an embodiment, the method comprises a treatment comprising introducing a cell into said subject's body, wherein said cell subject was contacted ex vivo with (a), (b), (d), and optionally (c)(i), further optionally (c)(ii), and still further optionally (c)(iii).

In an embodiment, the method comprises said contacting, e.g., contacting a cell of the subject, is performed in vivo. In an embodiment, contacting the cell of a subject in vivo is by subretinal delivery. In an embodiment, contacting the cell of a subject in vivo is by subretinal injection.

In an embodiment, the contacting step comprises contacting said subject with a nucleic acid, e.g., a vector, e.g., an AAV vector, described herein, e.g., a nucleic acid that expresses at least one of (a), (b), (c)(i), c(ii), or c(iii).

In an embodiment, the contacting step comprises delivering to said subject said Cas9 molecule of (b), as a protein or mRNA, and a nucleic acid which encodes (a), and optionally (c)(i), further optionally (c)(ii), and still further optionally (c)(iii).

In an embodiment, the contacting step comprises delivering to said subject said Cas9 molecule of (b), as a protein or mRNA, said gRNA of (a), as an RNA, and optionally said second gRNA of (c)(i), further optionally said third gRNA of (c)(ii), and still further optionally said third gRNA of (c)(iii), as an RNA.

In an embodiment, the contacting step comprises delivering to said subject said gRNA of (a), as an RNA, optionally said second gRNA of (c)(i), further optionally said third gRNA of (c)(ii), and still further optionally said third gRNA of (c)(iii), as an RNA, and a nucleic acid that encodes the Cas9 molecule of (b).

In another aspect, disclosed herein is a reaction mixture comprising a gRNA, a nucleic acid, or a composition described herein, and a cell, e.g., a cell from a subject having Usher syndrome or retinitis pigmentosa 39, or a subject having a mutation in the USH2A (or RP39) gene, e.g., a deletion of guanine at nucleotide positon 2299 (2299delG).

In another aspect, disclosed herein is a kit comprising (a) gRNA molecule described herein, or nucleic acid that encodes said gRNA, and one or more of the following:

(b) a Cas9 molecule, e.g., a Cas9 molecule described herein;

(c)(i) a second gRNA molecule, e.g., a second gRNA molecule described herein;

(c)(ii) a third gRNA molecule, e.g., a second gRNA molecule described herein; or (c)(iii) a fourth gRNA molecule, e.g., a second gRNA molecule described herein;

(d) a template nucleic acid e.g, a template nucleic acid described herein;

(e) nucleic acid that encodes one or more of (b), (c)(i), (c)(ii), (c)(iii), or (d).

In an embodiment, the kit comprises a nucleic acid, e.g., an AAV vector, that encodes one or more of (a), (b), (c)(i), (c)(ii), or c(iii).

In an embodiment, the kit further comprises a template nucleic acid, e.g., a single strand DNA that comprises said template nucleic acid.

In another aspect, disclosed herein is non-naturally occurring template nucleic acid described herein.

In yet another aspect, disclosed herein is a gRNA molecule, e.g., a gRNA molecule described herein, for use in treating Usher Syndrome or retinitis pigmentosa 39 in a subject, e.g., in accordance with a method of treating Usher Syndrome or retinitis pigmentosa 39 as described herein.

In an embodiment, the gRNA molecule in used in combination with a Cas9 molecule, e.g., a Cas9 molecule described herein. Additionally or alternatively, in an embodiment, the gRNA molecule is used in combination with a second, third and/or fourth gRNA molecule, e.g., a second, third and/or fourth gRNA molecule described herein. Additionally or alternatively, in an embodiment, the gRNA molecule is used in combination with a template nucleic acid, e.g., a template nucleic acid described herein.

In still another aspect, disclosed herein is use of a gRNA molecule, e.g., a gRNA molecule described herein, in the manufacture of a medicament for treating Usher Syndrome or retinitis pigmentosa 39 in a subject, e.g., in accordance with a method of treating Usher Syndrome or retinitis pigmentosa 39 as described herein.

In an embodiment, the medicament comprises a Cas9 molecule, e.g., a Cas9 molecule described herein. Additionally or alternatively, in an embodiment, the medicament comprises a second, third and/or fourth gRNA molecule, e.g., a second, third and/or fourth gRNA molecule described herein. Additionally or alternatively, in an embodiment, the medicament comprises a template nucleic acid, e.g., a template nucleic acid described herein.

The gRNA molecules and methods, as disclosed herein, can be used in combination with a governing gRNA molecule. As used herein, a governing gRNA molecule refers to a gRNA molecule comprising a targeting domain which is complementary to a target domain on a nucleic acid that encodes a component of the CRISPR/Cas system introduced into a cell or subject. For example, the methods described herein can further include contacting a cell or subject with a governing gRNA molecule or a nucleic acid encoding a governing molecule. In an embodiment, the governing gRNA molecule targets a nucleic acid that encodes a Cas9 molecule or a nucleic acid that encodes a target gene gRNA molecule. In an embodiment, the governing gRNA comprises a targeting domain that is complementary to a target domain in a sequence that encodes a Cas9 component, e.g., a Cas9 molecule or target gene gRNA molecule. In an embodiment, the target domain is designed with, or has, minimal homology to other nucleic acid sequences in the cell, e.g., to minimize off-target cleavage. For example, the targeting domain on the governing gRNA can be selected to reduce or minimize off-target effects. In an embodiment, a target domain for a governing gRNA can be disposed in the control or coding region of a Cas9 molecule or disposed between a control region and a transcribed region. In an embodiment, a target domain for a governing gRNA can be disposed in the control or coding region of a target gene gRNA molecule or disposed between a control region and a transcribed region for a target gene gRNA. While not wishing to be bound by theory, in an embodiment, it is believed that altering, e.g., inactivating, a nucleic acid that encodes a Cas9 molecule or a nucleic acid that encodes a target gene gRNA molecule can be effected by cleavage of the targeted nucleic acid sequence or by binding of a Cas9 molecule/governing gRNA molecule complex to the targeted nucleic acid sequence.

The compositions, reaction mixtures and kits, as disclosed herein, can also include a governing gRNA molecule, e.g., a governing gRNA molecule disclosed herein, Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

FIGS. 1A-1G are representations of several exemplary gRNAs.

FIG. 1A depicts a modular gRNA molecule derived in part (or modeled on a sequence in part) from *Streptococcus pyogenes* (*S. pyogenes*) as a duplexed structure (SEQ ID NOS: 42 and 43, respectively, in order of appearance);

FIG. 1B depicts a unimolecular (or chimeric) gRNA molecule derived in part from *S. pyogenes* as a duplexed structure (SEQ ID NO: 44);

FIG. 1C depicts a unimolecular gRNA molecule derived in part from *S. pyogenes* as a duplexed structure (SEQ ID NO: 45);

FIG. 1D depicts a unimolecular gRNA molecule derived in part from *S. pyogenes* as a duplexed structure (SEQ ID NO: 46);

FIG. 1E depicts a unimolecular gRNA molecule derived in part from *S. pyogenes* as a duplexed structure (SEQ ID NO: 47);

FIG. 1F depicts a modular gRNA molecule derived in part from *Streptococcus thermophilus* (*S. thermophilus*) as a duplexed structure (SEQ ID NOS: 48 and 49, respectively, in order of appearance);

FIG. 1G depicts an alignment of modular gRNA molecules of *S. pyogenes* (SEQ ID NOS: 42 and 52) and *S. thermophilus* (SEQ ID NOS: 48 and 49, respectively, in order of appearance).

FIGS. 2A-2G depict an alignment of Cas9 sequences from Chylinski et al. (RNA Biol. 2013; 10(5): 726-737). The N-terminal RuvC-like domain is boxed and indicated with a "Y". The other two RuvC-like domains are boxed and indicated with a "B". The HNH-like domain is boxed and indicated by a "G". Sm: *S. mutans* (SEQ ID NO: 1); Sp: *S. pyogenes* (SEQ ID NO: 2); St: *S. thermophilus* (SEQ ID NO: 3); Li: *L. innocua* (SEQ ID NO: 4). Motif: this is a motif based on the four sequences: residues conserved in all four sequences are indicated by single letter amino acid abbreviation; "*" indicates any amino acid found in the corresponding position of any of the four sequences; and "-" indicates any amino acid, e.g., any of the 20 naturally occurring amino acids, or absent.

FIGS. 3A-3B show an alignment of the N-terminal RuvC-like domain from the Cas9 molecules disclosed in Chylinski et al (SEQ ID NOS: 54, 56, and 58-103, respectively, in order of appearance). The last line of FIG. 3B identifies 4 highly conserved residues.

FIGS. 4A-4B show an alignment of the N-terminal RuvC-like domain from the Cas9 molecules disclosed in Chylinski et al. with sequence outliers removed (SEQ ID NOS: 54, 56, 58-63, 114, 64-75, 127, 76, 77, 130-135, 79, 78, 138, 80, 140, 81, 82, 84, 144, 83, 85, 147, 148, 89, 88, 86, 152, 91, 92, 102, 90, 87, 93, 94, 160-162, 95-101, 103, and 171-177, respectively, in order of appearance). The last line of FIG. 4B identifies 3 highly conserved residues.

FIGS. 5A-5C show an alignment of the HNH-like domain from the Cas9 molecules disclosed in Chylinski et al (SEQ ID NOS: 178-252, respectively, in order of appearance). The last line of FIG. 5C identifies conserved residues.

FIGS. 6A-6B show an alignment of the HNH-like domain from the Cas9 molecules disclosed in Chylinski et al. with sequence outliers removed (SEQ ID NOS: 178-196, 224, 197, 198, 206, 207, 209-211, 220, 199, 225, 228, 226, 227, 229-232, 221, 238, 235-237, 239-245, and 252, respectively, in order of appearance). The last line of FIG. 6B identifies 3 highly conserved residues.

FIGS. 7A-7B depict an alignment of Cas9 sequences from *S. pyogenes* and *Neisseria meningitidis* (*N. meningitidis*). The N-terminal RuvC-like domain is boxed and indicated with a "Y". The other two RuvC-like domains are boxed and indicated with a "B". The HNH-like domain is boxed and indicated with a "G". Sp: *S. pyogenes*; Nm: *N. meningitidis*. Motif: this is a motif based on the two sequences: residues conserved in both sequences are indicated by a single amino acid designation; "*" indicates any amino acid found in the corresponding position of any of the two sequences; "-" indicates any amino acid, e.g., any of the 20 naturally occurring amino acids, and "-" indicates any amino acid, e.g., any of the 20 naturally occurring amino acids, or absent.

FIG. 8 shows a nucleic acid sequence encoding Cas9 of *N. meningitidis* (SEQ ID NO: 303). Sequence indicated by an "R" is an SV40 NLS; sequence indicated as "G" is an HA tag; and sequence indicated by an "0" is a synthetic NLS sequence; the remaining (unmarked) sequence is the open reading frame (ORF).

FIG. 9A shows the organization of the Cas9 domains, including amino acid positions, in reference to the two lobes of Cas9 (recognition (REC) and nuclease (NUC) lobes). FIG. 9B shows the percent homology of each domain across 83 Cas9 orthologs.

DETAILED DESCRIPTION

Definitions

Figure 1A:
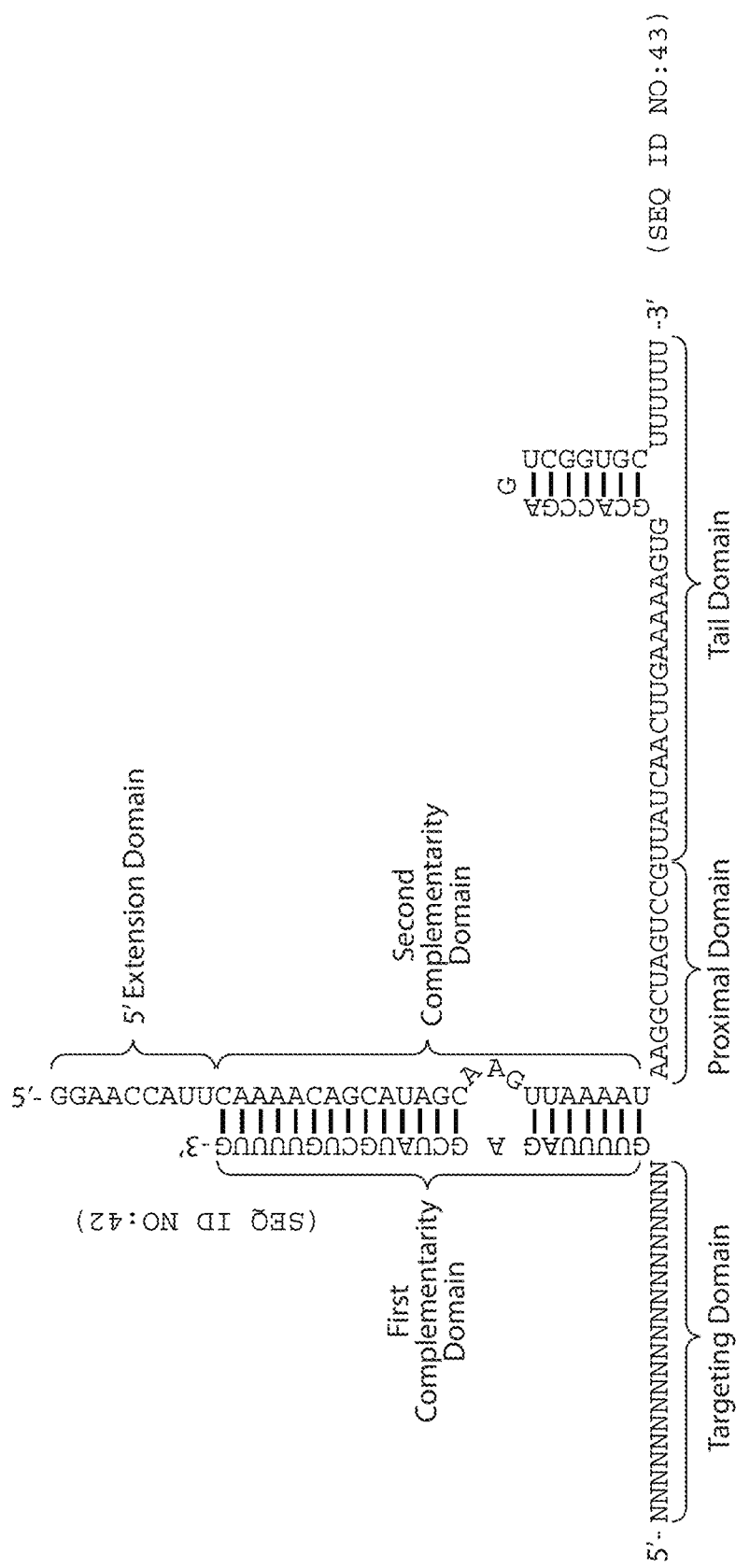

Domain, as used herein, is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Governing gRNA molecule", as used herein, refers to a gRNA molecule that comprises a targeting domain that is complementary to a target domain on a nucleic acid that comprises a sequence that encodes a component of the CRISPR/Cas system that is introduced into a cell or subject. A governing gRNA does not target an endogenous cell or subject sequence. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the USH2A gene (a target gene gRNA); or on more than one nucleic acid that encodes a CRISPR/Cas component, e.g., both (a) and (b). In an embodiment, a nucleic acid molecule that encodes a CRISPR/Cas component, e.g., that encodes a Cas9 molecule or a target gene gRNA, comprises more than one target domain that is complementary with a governing gRNA targeting domain. While not wishing to be bound by theory, in an embodiment, it is believed that a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In an embodiment, the Cas9 molecule forms two complexes: a complex comprising a Cas9 molecule with a target gene gRNA, which complex will alter the USH2A gene; and a complex comprising a Cas9 molecule with a governing gRNA molecule, which complex will act to prevent further production of a CRISPR/Cas system component, e.g., a Cas9 molecule or a target gene gRNA molecule. In an embodiment, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In an embodiment, a governing gRNA molecule/Cas9 molecule complex binds to or promotes cleavage of a control region sequence, e.g., a promoter, operably linked to a gRNA molecule, or a sequence that encodes the gRNA molecule. In an embodiment, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In an embodiment, a governing gRNA places temporal, level of expression, or other limits, on activity of the Cas9 molecule/target gene gRNA molecule complex. In an embodiment, a governing gRNA reduces off-target or other unwanted activity. In an embodiment, a governing gRNA molecule inhibits, e.g., entirely or substantially entirely inhibits, the production of a component of the Cas9 system and thereby limits, or governs, its activity.

"Modulator", as used herein, refers to an entity, e.g., a drug, that can alter the activity (e.g., enzymatic activity, transcriptional activity, or translational activity), amount, distribution, or structure of a subject molecule or genetic sequence. In an embodiment, modulation comprises cleavage, e.g., breaking of a covalent or non-covalent bond, or the forming of a covalent or non-covalent bond, e.g., the attachment of a moiety, to the subject molecule. In an embodiment, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics and carbohydrates.

"Polypeptide", as used herein, refers to a polymer of amino acids having less than 100 amino acid residues. In an embodiment it has less than 50, 20, or 10 amino acid residues.

"Reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule is compared. For example, a Cas9 molecule may be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of S. pyogenes S. aureus or S. thermophilus. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment the subject is a human. In other embodiments the subject is poultry.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"X", as used herein, in the context of an amino acid sequence, refers to any amino acid (e.g., any of the twenty natural amino acids) unless otherwise specified.

Usher Syndrome

Usher syndrome is a disease characterized by progressive loss of vision beginning between the ages of 10 and 20. Usher syndrome type 1 symptoms are generally more severe and have an earlier onset than those of Usher syndrome type 2 (e.g., Usher syndrome type 2A). The vision loss in Usher syndrome is described as retinitis pigmentosa (RP), a group of inherited retinal dystrophies that affect photoreceptors and retinal pigment epithelium cells.

Subjects suffering from Usher syndrome type II have mutations in the USH2A gene (also known as the RP39 gene) and develop vision loss that is accompanied by hearing loss (and/or balance problems). The visual loss associated with Usher syndrome type II is called 'syndromic' retinitis pigmentosa, because it is associated with hearing loss. Alternatively, patients can have mutations in USH2A that are not associated with hearing loss. In this case, the patients are defined as having 'non-syndromic' retinitis pigmentosa. Non-syndromic retinitis pigmentosa caused by mutations in the USH2A gene is also called retinitis pigmentosa 39, or RP39. In both syndromic and non-syndromic RP, repair of the USH2A mutations within the eye may ameliorate or slow the progression of retinitis pigmentosa. In syndromic RP, repair of USH2A mutations may ameliorate vision loss but not address hearing loss. In non-syndromic RP, repair of USH2A may ameliorate vision loss (but not hearing loss as there in no hearing loss in non-syndromic RP).

The USH2A gene is 85,000 base pairs and codes for the usherin protein. Usherin is expressed in photoreceptors of the retina and in inner hair cells and outer hair cells in the inner ear. The most common mutation in subjects with Usher syndrome type II or non-syndromic retinitis pigmentosa (RP39) is a single nucleotide deletion, e.g., a guanine deletion, at nucleotide position 2299 (2299delG) in the USH2A gene, which is responsible for somewhere between 15% and 40% of USH2A mutations. The deletion of guanine at position 2299 results in a premature stop codon.

The USH2A gene is expressed in retinal photoreceptor (PR) rods and cones. Photorecptors cells have an outer segment made of a cilium that plays an important role in the retinoid cycle and the phototransduction cascade. The USH2A gene encodes the usherin protein which is responsible for protein trafficking in the PR outer segment. Mutations in the USH2A gene leads to interrupted protein transport between the ciliary inner segment and outer segment. This causes PR dysfunction and loss of vision in retinitis pigmentosa.

As RP progresses, PR rods generally degenerate first. In most cases of RP, rod photoreceptor cells function poorly and begin to die at the earliest stages of disease, resulting in poor night vision and declining peripheral vision. PR cones generally degenerate late in the course of disease. This causes the typical phenotypic progression experienced by RP patients. They experience loss of peripheral visual fields followed by loss of central visual fields (the latter measured by decreases in visual acuity).

Methods to Treat or Prevent Usher Syndrome Type 2A and/or Retinitis Pigmentosa 39

Treatment for RP is limited and there is currently no approved treatment that substantially reverses or halts the progression of disease in Usher Syndrome type 2 or in RP-39. Vitamin A supplementation may delay onset of disease and slow progression. An electrical implant known as the *Argus* II retinal implant was recently approved for use, but it only offers minimal improvement in vision in patients with RP. The best visual acuity achieved in trials by the device was 20/1260 (legal blindness is defined as 20/200 vision). In addition, current gene therapy delivery techniques are not able to deliver genes encoding large proteins, e.g., the USH2A gene.

In the retina, the USH2A gene is expressed in retinal photoreceptor (PR) rods and cones. Photorecptors cells have an outer segment made of a cilium that plays an important role in the retinoid cycle and the phototransduction cascade. The USH2A gene encodes the usherin protein that is responsible for protein trafficking in the PR outer segment. Mutations in the USH2A gene leads to interrupted protein transport between the ciliary inner segment and outer segment. This causes PR dysfunction and eventual loss of vision in retinitis pigmentosa.

As RP progresses, PR rods generally degenerate first. In most cases of RP, rod photoreceptor cells function poorly and begin to die at the earliest stages of disease, resulting in poor night vision and declining peripheral vision. PR cones generally degenerate late in the course of disease. This causes the typical phenotypic progression experienced by RP patients. They experience loss of peripheral visual fields followed by loss of central visual fields (the latter measured by decreases in visual acuity).

Correction of the USH2A gene (e.g., insertion of the deleted guanine residue at nucleotide position 2299) in the eye may delay disease progression or improve in vision, or both. Restoring functional usherin to PR rods and cones is predicted to preserve communication and functioning within PR cells. This may delay or prevent PR cell death in subjects with Usher syndrome type 2 and RP39. Following correction of the USH2A gene, subjects can experience delayed disease progression and/or improvements in vision.

In the inner ear, the USH2A gene is expressed in inner and outer hair cells. Hair cells are responsible for mechanotransduction within the inner ear, a process in which sound waves are converted to electrical signals that are picked up by neurons in the inner ear and converted into sounds. Stereo cilia within hair cells rely on functional usherin to interact with myosin 7A, whirlin and harmonin proteins for effective mechanotransduction (see Adato et al., Human Molecular Genetics 2005; 14(24):3921-3932, in particular, FIG. 6). Truncated or errant splicing of harmonin leads to dysfuction of the interconnections of harmonin and other stereociliary proteins, which leads to disruption in hearing.

Correction of the USH2A gene in the inner ear can delay progression of hearing loss or improve hearing or both. Following correction of the USH2A gene, subjects can experience delayed disease progression and/or improvements in hearing.

As disclosed herein, USH2A mutations may be corrected by gene editing, e.g., using CRISPR-Cas9 mediated methods to correct the guanine deletion at position 2299 in the USH2A gene (i.e., replace the deleted guanine residue at position 2299 in the USH2A gene).

Described herein are methods for treating or delaying the onset or progression of Usher syndrome type 2A and/or retinitis pigmentosa 39 (RP39), e.g., caused by mutations in the USH2A gene, including but not limited to the mutations: c.2299delG. The disclosed methods for treating or delaying the onset or progression of Usher type 2A and/or RP39 alter the USH2A gene by genome editing using a gRNA targeting the Usher type 2A and/or RP39 target position and a Cas9 enzyme. Details on gRNAs targeting the Usher type 2A and/or RP39 target position and Cas9 enzymes are provided below.

In a method disclosed herein, a mutation is targeted by cleaving with either a single nuclease or dual nickase, e.g., to induce HDR with a donor template, that corrects the point mutation (e.g., the single nucleotide, e.g., guanine, deletion). The method can include acquiring knowledge of the mutation carried by the subject, e.g., by sequencing the appropriate portion of the USH2A gene.

Usher syndrome involves, e.g., hearing loss and a progressive decline in visual acuity and treatment during the earlier stages of the disease may prevent further decline in visual acuity. Some subjects with Usher syndrome may benefit from treatment at later stages of the disease. Physicians detecting hearing loss or loss of visual acuity in a young subject may consider determining or acquiring the relevant USH2A sequence in the subject to determine whether the hearing loss or loss of visual acuity is due to a mutation in the USH2A gene. If so, the subject may be a candidate for treatment.

In an embodiment, treatment is initiated prior to onset of the disease.

In an embodiment, treatment is initiated after onset of the disease.

In an embodiment, treatment is initiated prior to loss of visual acuity.

In an embodiment, treatment is initiated at onset of loss of visual acuity.

In an embodiment, treatment is initiated after onset of loss of visual acuity.

In an embodiment, treatment is initiated prior to loss of hearing.

In an embodiment, treatment is initiated at onset of loss of hearing.

In an embodiment, treatment is initiated after onset of loss of hearing.

In an embodiment, the subject undergoes genetic testing and is found to have a mutation in the USH2A gene.

In an embodiment, treatment is initiated at the appearance of any of the following symptoms: declining peripheral vision, poor night vision or night blindness, progressive visual loss, and/or progression constriction of the visual field.

In an embodiment, treatment is initiated before the appearance of any of the following symptoms: declining peripheral vision, poor night vision or night blindness, progressive visual loss, and/or progression constriction of the visual field.

In an embodiment, treatment is initiated after the appearance of any of the following symptoms: declining peripheral vision, poor night vision or night blindness, progressive visual loss, and/or progression constriction of the visual field.

In an embodiment, treatment is initiated at the appearance of any of the following findings consistent with Usher syndrome or RP on exam, including but not limited to, bone spicule pigmentation, narrowing of the visual fields, retinal atrophy, attenuated retinal vasculature, loss of retinal pigment epithelium, and/or pallor of the optic nerve.

In an embodiment, treatment is initiated before the appearance of any of the following findings consistent with Usher syndrome or RP on exam, including but not limited to, bone spicule pigmentation, narrowing of the visual fields, retinal atrophy, attenuated retinal vasculature, loss of retinal pigment epithelium, and/or pallor of the optic nerve.

In an embodiment, treatment is initiated after the appearance of any of the following findings consistent with Usher syndrome or RP on exam, including but not limited to, bone spicule pigmentation, narrowing of the visual fields, retinal atrophy, attenuated retinal vasculature, loss of retinal pigment epithelium, and/or pallor of the optic nerve.

In an embodiment, treatment is initiated at the appearance of any of the following symptoms: hearing loss, hearing impairment, reduced hearing, and/or profound deafness.

In an embodiment, treatment is initiated before the appearance of any of the following symptoms: hearing loss, hearing impairment, reduced hearing, and/or profound deafness.

In an embodiment, treatment is initiated after the appearance of any of the following symptoms: hearing loss, hearing impairment, reduced hearing, and/or profound deafness.

In an embodiment, treatment is initiated at the appearance of any of the following findings consistent with hearing loss on exam, including but not limited to, down-sloping configuration on audiogram, hearing loss on otoacoustic emissions (OAE) test, and/or hearing loss on Electrocochleography.

In an embodiment, treatment is initiated before the appearance of any of the following findings consistent with hearing loss on exam, including but not limited to, down-sloping configuration on audiogram, hearing loss on otoacoustic emissions (OAE) test, and/or hearing loss on Electrocochleography.

In an embodiment, treatment is initiated after the appearance of any of the following findings consistent with hearing loss on exam, including but not limited to, down-sloping configuration on audiogram, hearing loss on otoacoustic emissions (OAE) test, and/or hearing loss on Electrocochleography.

In an embodiment, treatment is initiated between the ages of 10 and 20.

In an embodiment, treatment is initiated prior to the age of 10.

In an embodiment, treatment is initiated prior to the age of 20.

In an embodiment, treatment is initiated after the age of 20.

In an embodiment, treatment is initiated after the age of 30.

In an embodiment, treatment is initiated after the age of 40.

In an embodiment, treatment is initiated after the age of 50.

In an embodiment, treatment is initiated after the age of 60.

In an embodiment, treatment is initiated at the appearance of loss of visual acuity in a subject's first two decades of life.

In an embodiment, treatment is initiated at the appearance of loss of hearing in a subject's first two decades of life.

In an embodiment, treatment is initiated after a subject is determined to have a mutation, e.g., a guanine deletion at position 2299 in USH2A by genetic screening, e.g., genotyping, wherein the genetic testing was performed prior to or after disease onset.

A subject's vision can be evaluated, e.g., prior to treatment, or after treatment, e.g., to monitor the progress of the treatment. In an embodiment, a subject's vision is evaluated prior to treatment, e.g., to determine the need for treatment. In an embodiment, a subject's vision is evaluated after treatment has been initiated, e.g., to access the effectiveness of the treatment. Vision can be evaluated by one or more of: evaluating changes in function relative to the contralateral eye, e.g., by utilizing retinal analytical techniques; by evaluating mean, median and distribution of change in best corrected visual acuity (BCVA); evaluation by Optical Coherence Tomography; evaluation of changes in visual field using perimetry; evaluation by full-field electroretinography (ERG); evaluation by slit lamp examination; evaluation of intraocular pressure; evaluation of autofluorescence, evaluation with fundoscopy; evaluation with fundus photography; evaluation with fluorescein angiography (FA); or evaluation of visual field sensitivity (FFST).

A subject's hearing can be evaluated, e.g., prior to treatment, or after treatment, e.g., to monitor the progress of the treatment. In an embodiment, a subject's hearing is evaluated prior to treatment, e.g., to determine the need for treatment. In an embodiment, a subject's hearing is evaluated after treatment has been initiated, e.g., to access the effectiveness of the treatment. Hearing can be evaluated by one or more of: evaluating changes in function relative to the contralateral ear, e.g., by evaluating by physical exam, e.g., by evaluating by audiogram, e.g., by evaluating by otoacoustic emissions (OAE) test, e.g., by evaluating by electrocochleography.

Methods of Altering USH2A

As disclosed herein, USH2A mutations can be corrected by gene editing, e.g., using CRISPR-Cas9 mediated methods to correct a mutation in the USH2A gene, e.g., the guanine deletion at position 2299 in the USH2A gene (e.g., replace the deleted guanine residue at position 2299 in the USH2A gene).

In a method disclosed herein, a mutation is targeted by cleaving with either one or more nuclease, one or more nickase, or a combination thereof, e.g., to induce HDR with a donor template that corrects the point mutation (e.g., the single nucleotide, e.g., guanine, deletion). The method can include acquiring knowledge of the mutation carried by the subject, e.g., by sequencing the appropriate portion of the USH2A gene.

Methods and compositions discussed herein, provide for altering the USH2A target position in the USH2A gene. USH2A target position can be altered (e.g., corrected) by gene editing, e.g., using CRISPR-Cas9 mediated methods to correct a mutation in the USH2A gene, e.g., the guanine deletion at position 2299 in the USH2A gene (e.g., replace the deleted guanine residue at position 2299, e.g., 2299delG in the USH2A gene).

The alteration (e.g., correction) of the mutant USH2A gene can be mediated by any mechanism. Exemplary mechanisms that can be associated with the alteration (e.g., correction) of the mutant HSH2A gene include, but ar not limited to, non-homologous end joining (e.g., classical or alternative), microhomology-mediated end joining (MMEJ), homology-directed repair (e.g., endogenous donor template mediated), SDSA (synthesis dependent strand annealing), single strand annealing or single strand invasion.

The methods and compositions described herein introduce one or more breaks near the target position (e.g., 2299delG) in the USH2A gene. In an embodiment, a mutation (e.g., 2299delG) is targeted by cleaving with either one or more nucleases, one or more nickases or any combination thereof to induce HDR with a donor template that corrects the point mutation (e.g., the single nucleotide, e.g., guanine, deletion, e.g., 2299delG). The method can include acquiring knowledge of the mutation carried by the subject, e.g., by sequencing the appropriate portion of the USH2A gene.

In an embodiment, guide RNAs were designed to target a mutation (e.g., 2299delG) in the USH2A gene. A single gRNA with a Cas9 nuclease or a Cas9 nickase could be used to generate a break (e.g., a single strand break or a double strand break) in close proximity to a mutation (e.g., 2299delG). While not bound by theory, in an embodiment, it is believed that HDR-mediated repair (e.g., with a donor template) of the break (e.g., a single strand break or a double strand break) allows for the correction of the mutation (e.g., 2299delG) which results in restoration of a functional usherin protein.

In another embodiment, two gRNAs with two Cas9 nickases could be used to generate two single strand breaks in close proximity to a mutation (e.g., 2299delG). While not bound by theory, in an embodiment, it is believed that HDR-mediated repair (e.g., with a donor template) of the breaks (e.g., the two single strand breaks) allow for the correction of the mutation (e.g., 2299delG) which results in restoration of a functional usherin protein.

In another embodiment, more than two gRNAs may be used in a dual-targeting approach to generate two sets of breaks (e.g., two double strand breaks, one double strand break and a pair of single strand breaks or two pairs of single strand breaks) in close proximity to a mutation (e.g., 2299delG) or delete a genomic sequence containing a mutation (e.g., 2299delG) in the USH2A gene. While not bound by theory, in an embodiment, it is believed that HDR-mediated repair (e.g., with a donor template) of the breaks (e.g., two double strand breaks, one double strand break and a pair of single strand breaks or two pairs of single strand breaks) allow for the correction of the mutation (e.g., 2299delG) which results in restoration of a functional usherin protein.

In an embodiment, a single strand break is introduced (e.g., positioned by one gRNA molecules) in close proximity to a mutation (e.g., 2299delG) in the USH2A gene. In an embodiment, when a single gRNA molecule is used to target a Cas9 nickase to create a single strand break in close proximity to the mutation, eg., the gRNA is used to target either upstream of (e.g., within 200 bp upstream of the mutation), or downstream of (e.g., within 200 bp downstream of the mutation) in the USH2A gene. In an embodiment, the break is positioned to avoid unwanted target chromosome elements, such as repeat elements, e.g., an Alu repeat.

In an embodiment, a double strand break is introduced (e.g., positioned by one gRNA molecules) in close proximity to a mutation (e.g., 2299delG) in the USH2A gene. In an embodiment, when a single gRNA molecule is used to target a Cas9 nuclease to create a double strand break in close proximity to the mutation, eg., the gRNA is used to target either upstream of (e.g., within 200 bp upstream of the mutation), or downstream of (e.g., within 200 bp downstream of the mutation) in the USH2A gene. In an embodiment, the break is positioned to avoid unwanted target chromosome elements, such as repeat elements, e.g., an Alu repeat.

In an embodiment, two single strand breaks are introduced (e.g., positioned by two gRNA molecules) in close proximity to a mutation (e.g., 2299delG) in the USH2A gene. In an embodiment, when two gRNA molecules are used to target two Cas9 nickcases to create two single strand breaks in close proximity to the mutation, e.g., both gRNAs are used to target upstream of (e.g., within 200 bp upstream of the mutation), both gRNAs are used to target downstream of (e.g., within 200 bp downstream of the mutation), or one is upstream (e.g., within 200 bp upstream of the mutation) and the second one is downstream (e.g., within 200 bp downstream of the mutation) of the mutation (e.g., 2299delG) in the USH2A gene. In an embodiment, the break is positioned to avoid unwanted target chromosome elements, such as repeat elements, e.g., an Alu repeat.

In an embodiment, two sets of breaks (e.g., two double strand breaks) are introduced (e.g., positioned by two gRNA molecules) in close proximity to a mutation (e.g., 2299delG) in the USH2A gene. In an embodiment, two gRNA molecule are used to target two Cas9 nucleases to create two double strand breaks to flank a mutation (e.g., 2299delG), eg., one gRNA is used to target upstream of (e.g., within 200 bp upstream of the mutation) while a second gRNA is used to target downstream of (e.g., within 200 bp downstream of the mutation) of a mutation (e.g., 2299delG) in the USH2A gene. In an embodiment, the breaks are positioned to avoid unwanted target chromosome elements, such as repeat elements, e.g., an Alu repeat.

In an embodiment, two sets of breaks (e.g., one double strand break and a pair of nickases) are introduced (e.g., positioned by three gRNA molecules) in close proximity to a mutation (e.g., 2299delG) in the USH2A gene. In an embodiment, three gRNA molecules are used to target three Cas9 molecules to create two sets of breaks (e.g., one double strand break and a pair of nickases)) to flank a mutation (e.g., 2299delG), eg., one gRNA molecule is used to target upstream or downstream of (e.g., within 200 bp upstream or downstream of the mutation) while a second and a third gRNA molecules are used to target the opposite site (e.g., within 200 bp downstream or upstream) of of a mutation (e.g., 2299delG) in the USH2A gene. In an embodiment, the breaks are positioned to avoid unwanted target chromosome elements, such as repeat elements, e.g., an Alu repeat.

In an embodiment, two sets of breaks (e.g., two pairs of strand breaks) are introduced (e.g., positioned by four gRNA molecules) in close proximity to a mutation (e.g., 2299delG) in the USH2A gene. In an embodiment, four gRNA molecule are used to target four Cas9 nickases to create two pairs of single strand breaks to flank a mutation (e.g., 2299delG), eg., one and a second gRNA molecules are used to target upstream of (e.g., within 200 bp upstream of the mutation) while a third and a fourth gRNA molecules are used to target downstream of (e.g., within 200 bp downstream of the mutation) of a mutation (e.g., 2299delG) in the USH2A gene. In an embodiment, the breaks are positioned to avoid unwanted target chromosome elements, such as repeat elements, e.g., an Alu repeat.

When two gRNAs designed for use to target two Cas9 enzymes, one Cas9 can be one species, the second Cas9 can be from a different species. Both Cas9 species are used to generate a single or double-strand break, as desired.

I. sRNA Molecules

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule), sometimes referred to hereins as "chimeric" gRNAs, or modular (comprising more than one, and typically two, separate RNA molecules). A gRNA molecule comprises a number of domains. The gRNA molecule domains are described in more detail below.

Several exemplary gRNA structures, with domains indicated thereon, are provided in FIG. 1A-1G. While not wishing to be bound by theory, in an embodiment, with regard to the three dimensional form, or intra- or inter-strand interactions of an active form of a gRNA, regions of high complementarity are sometimes shown as duplexes in FIGS. 1A-1G and other depictions provided herein.

In an embodiment, a unimolecular, or chimeric, gRNA comprises, preferably from 5' to 3':
  a targeting domain (which is complementary to a target nucleic acid in the USH2A gene, e.g., a targeting domain from any of Tables 1-3, 4A-4E, 5A-5F, or 6A-6D;
  a first complementarity domain;
  a linking domain;
  a second complementarity domain (which is complementary to the first complementarity domain);
  a proximal domain; and
  optionally, a tail domain.

In an embodiment, a modular gRNA comprises:
  a first strand comprising, preferably from 5' to 3';
    a targeting domain (which is complementary to a target nucleic acid in the USH2A gene, e.g., a targeting domain from any of Tables 1-3, 4A-4E, 5A-5F, or 6A-6D; and
    a first complementarity domain; and
  a second strand, comprising, preferably from 5' to 3':
    optionally, a 5' extension domain;
    a second complementarity domain;
    a proximal domain; and
    optionally, a tail domain.

The domains are discussed briefly below:

The Targeting Domain

FIGS. 1A-1G provide examples of the placement of targeting domains.

The targeting domain comprises a nucleotide sequence that is complementary, e.g., at least 80, 85, 90, or 95% complementary, e.g., fully complementary, to the target sequence on the target nucleic acid. The targeting domain is part of an RNA molecule and therefore comprises the base uracil (U), while any DNA encoding the gRNA molecule comprises the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises two domains, which are, in the 5' to 3' direction, an optional secondary domain, and a core domain. In an embodiment, the core domain is fully complementary with the target sequence. In an embodiment, the targeting domain is 5 to 50 nucleotides in length. The strand of the target nucleic acid with which the targeting domain is complementary is referred to herein as the complementary strand. Some or all of the nucleotides of the domain can have a modification, e.g., a modification found in Section VIII herein.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

Targeting domains are discussed in more detail below.

The First Complementarity Domain

FIGS. 1A-1G provide examples of first complementarity domains.

The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complementarity domain comprises 3 subdomains, which, in the 5' to 3' direction are: a 5' subdomain, a central subdomain, and a 3' subdomain. In an embodiment, the 5' subdomain is 4-9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4-22, 4-18, or 4 to 10, or 3, 4, 5, 6, 7, 8, 9, 10, 11, 12, 13, 14, 15, 16, 17, 18, 19, 20, 21, 22, 23, 24, or 25, nucleotides in length.

The first complementarity domain can share homology with, or be derived from, a naturally occurring first complementarity domain. In an embodiment, it has at least 50% homology with a first complementarity domain disclosed herein, e.g., an S. pyogenes, S. aureus or S. thermophilus, first complementarity domain.

Some or all of the nucleotides of the domain can have a modification, e.g., modification found in Section VIII herein.

First complementarity domains are discussed in more detail below.

The Linking Domain

FIGS. 1A-1G provide examples of linking domains.

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains, see, e.g., FIGS. 1B-1E. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains see e.g., FIG. 1A.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., a modification found in Section VIII herein.

Linking domains are discussed in more detail below.

The 5' Extension Domain

In an embodiment, a modular gRNA can comprise additional sequence, 5' to the second complementarity domain, referred to herein as the 5' extension domain, see, e.g., FIG. 1A. In an embodiment, the 5' extension domain is 2-10, 2-9, 2-8, 2-7, 2-6, 2-5, 2-4 nucleotides in length. In an embodiment, the 5' extension domain is 2, 3, 4, 5, 6, 7, 8, 9, or 10 or more nucleotides in length.

The Second Complementarity Domain

FIGS. 1A-1G provide examples of second complementarity domains.

Figure 1B:
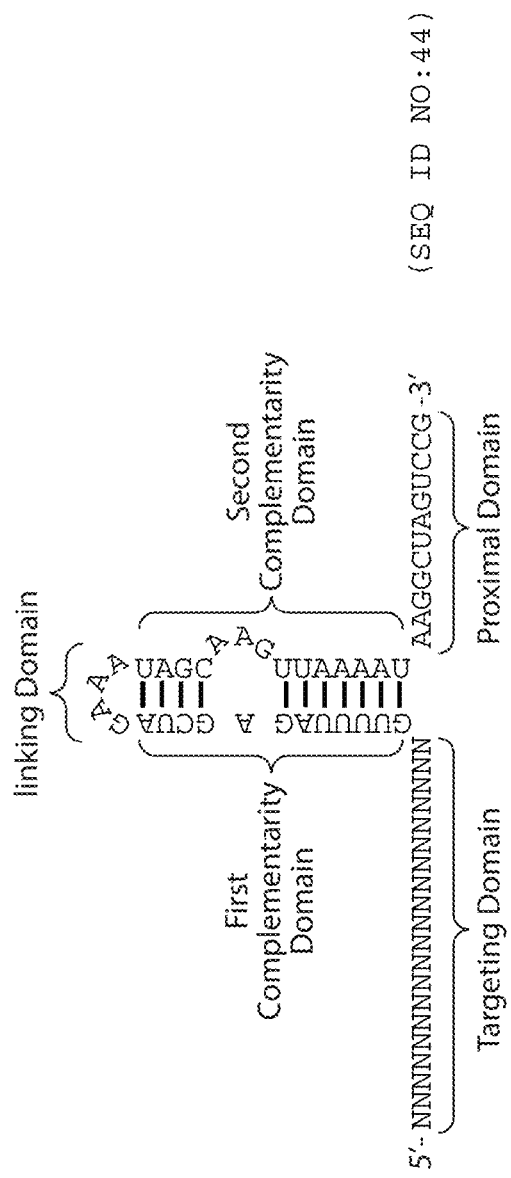
Figure 1C:
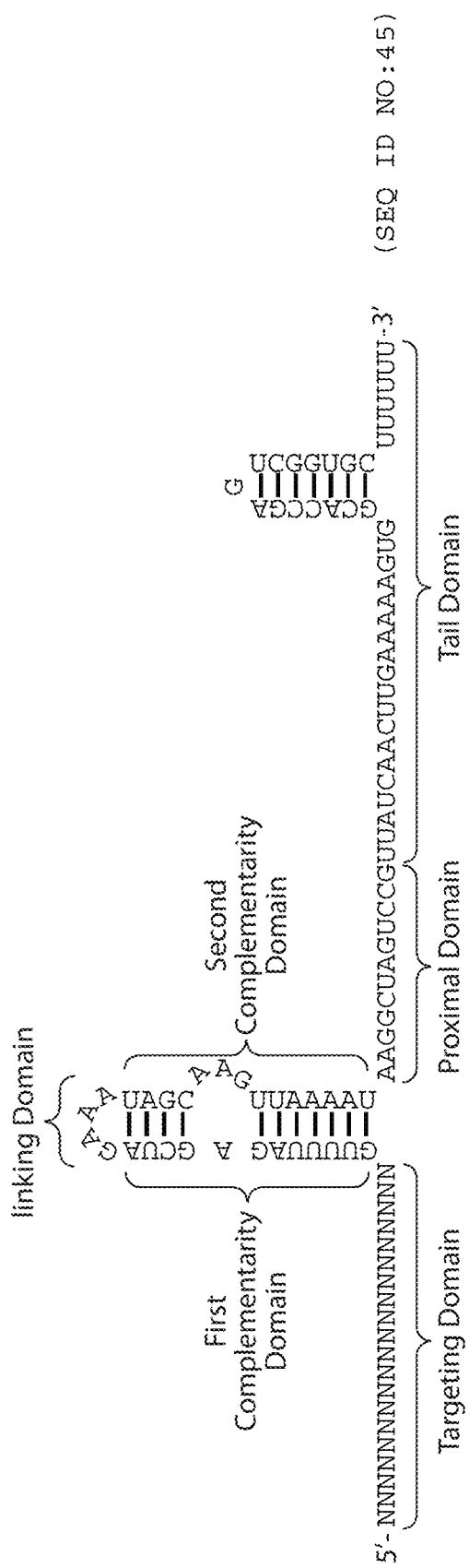
Figure 1D:
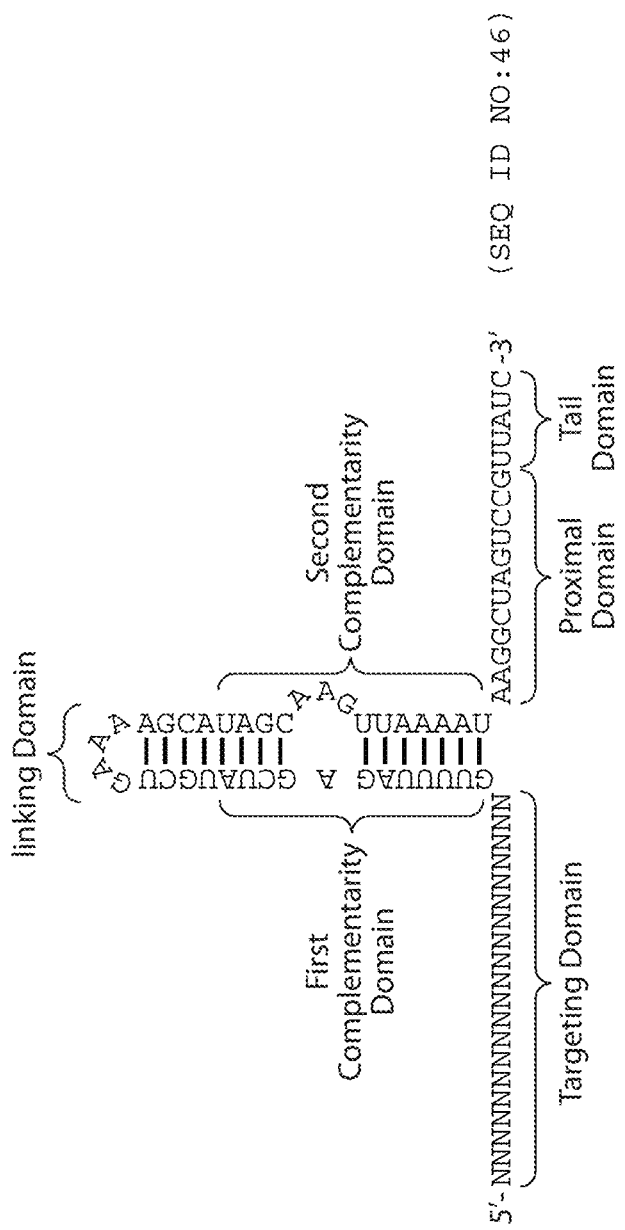
Figure 1E:
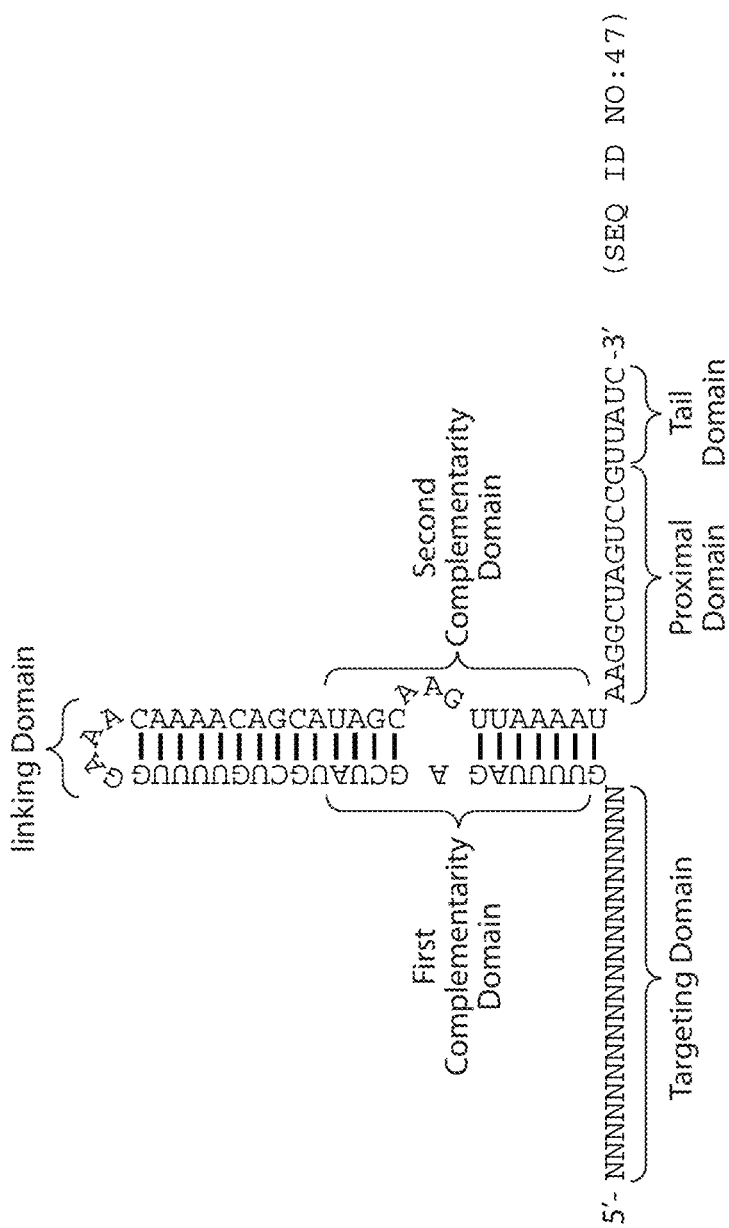

The second complementarity domain is complementary with the first complementarity domain, and in an embodiment, has sufficient complementarity to the second complementarity domain to form a duplexed region under at least some physiological conditions. In an embodiment, e.g., as shown in FIGS. 1A-1B, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementarity region. In an embodiment, the second complementary domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24 or 25 nucleotides in length.

In an embodiment, the second complementarity domain comprises three subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24 or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment it has at least 50% homology with a second complementarity domain disclosed herein, e.g., an *S. pyogenes, S. aureus* or *S. thermophilus*, second complementarity domain.

Some or all of the nucleotides of the domain can have a modification, e.g., modification found in Section VIII herein.

The Proximal Domain

FIGS. 1A-1G provide examples of proximal domains.

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus* or *S. thermophilus*, proximal domain.

Some or all of the nucleotides of the domain can have a modification, e.g., modification found in Section VIII herein.

The Tail Domain

FIGS. 1A-1G provide examples of tail domains.

As can be seen by inspection of the tail domains in FIGS. 1A-1G, a broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain, see e.g., FIG. 1D or 1E. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus* or *S. thermophilus*, tail domain.

In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

The domains of gRNA molecules are described in more detail below.

The Targeting Domain

The "targeting domain" of the gRNA is complementary to the "target domain" on the target nucleic acid. The strand of the target nucleic acid comprising the core domain target is referred to herein as the "complementary strand" of the target nucleic acid. Guidance on the selection of targeting domains can be found, e.g., in Fu Y et al., NAT BIOTECHNOL 2014 (doi: 10.1038/nbt.2808) and Sternberg S H et al., NATURE 2014 (doi: 10.1038/nature13011).

In an embodiment, the targeting domain is 16, 17, 18, 19, 20, 21, 22, 23, 24, 25 or 26 nucleotides in length.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+1-5 nucleotides, in length.

In an embodiment, the targeting domain is 20+/−5 nucleotides in length.

In an embodiment, the targeting domain is 20+/−10, 30+/−10, 40+/−10, 50+/−10, 60+/−10, 70+/−10, 80+/−10, 90+/−10, or 100+/−10 nucleotides, in length.

In an embodiment, the targeting domain is 30+/−10 nucleotides in length.

In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In some embodiments, the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 molecule to the target nucleic acid.

In some embodiments, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no non-complementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section VIII. However, in an embodiment, the targeting domain comprises one or more modifications, e.g., modifications that it render it less susceptible to degradation or more bio-compatible, e.g., less immunogenic. By way of example, the backbone of the targeting domain can be modified with a phosphorothioate, or other modification(s) from Section VIII. In an embodiment, a nucleotide of the targeting domain can comprise a 2' modification, e.g., a 2-acetylation, e.g., a 2' methylation, or other modification(s) from Section VIII.

In some embodiments, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In some embodiments, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected so as to not interfere with targeting efficacy, which can be evaluated by testing a candidate modification in the system described in Section IV. gRNAs having a candidate targeting domain having a selected length, sequence, degree of complementarity, or degree of modification, can be evaluated in a system in Section IV. The candidate targeting domain can be placed, either alone, or with one or more other candidate changes in a gRNA molecule/Cas9 molecule system known to be functional with a selected target and evaluated.

In some embodiments, all of the modified nucleotides are complementary to and capable of hybridizing to corresponding nucleotides present in the target domain. In other embodiments, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'→3' direction: a secondary domain and a core domain. These domains are discussed in more detail below.

The Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain). In an embodiment, the secondary domain is absent or optional.

In an embodiment, the secondary domain is absent or optional.

In an embodiment, the core domain and targeting domain, are independently, 6+/−2, 7+/−2, 8+/−2, 9+/−2, 10+/−2, 11+/−2, 12+/−2, 13+/−2, 14+/−2, 15+/−2, 16+−2, 17+/−2, or 18+/−2, nucleotides in length.

In an embodiment, the core domain a targeting domain, are independently, 10+/−2 nucleotides in length.

In an embodiment, the core domain and targeting domain are independently 10+/−4 nucleotides in length.

In an embodiment, the core domain and targeting domain are independently 6, 7, 8, 9, 10, 11, 12, 13, 14, 15, 16, 17, or 18, nucleotides in length.

In an embodiment, the core domain and targeting domain are independently 3 to 20, 4 to 20, 5 to 20, 6 to 20, 7 to 20, 8 to 20, 9 to 20 10 to 20 or 15 to 20 nucleotides in length.

In an embodiment, the core domain and targeting domain are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain is complementary with the core domain target. Typically the core domain has exact complementarity with the core domain target. In some embodiments, the core domain can have 1, 2, 3, 4 or 5 nucleotides that are not complementary with the corresponding nucleotide of the core domain. In an embodiment, the degree of complementarity, together with other properties of the gRNA, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 12 to 17 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14 or 15 nucleotides in length.

The secondary domain is complementary with the secondary domain target. Typically the secondary domain has exact complementarity with the secondary domain target. In some embodiments the secondary domain can have 1, 2, 3, 4 or 5 nucleotides that are not complementary with the corresponding nucleotide of the secondary domain. In an embodiment, the degree of complementarity, together with other properties of the gRNA, is sufficient to allow targeting of a Cas9 molecule to the target nucleic acid.

In an embodiment, the core domain nucleotides do not comprise modifications, e.g., modifications of the type provided in Section VIII. However, in an embodiment, the core domain comprise one or more modifications, e.g., modifications that it render it less susceptible to degradation or more bio-compatible, e.g., less immunogenic. By way of example, the backbone of the core domain can be modified with a phosphorothioate, or other modification(s) from Section VIII. In an embodiment a nucleotide of the core domain can comprise a 2' modification, e.g., a 2-acetylation, e.g., a 2' methylation, or other modification(s) from Section VIII. Typically, a core domain will contain no more than 1, 2, or 3 modifications.

Modifications in the core domain can be selected so as to not interfere with targeting efficacy, which can be evaluated by testing a candidate modification in the system described in Section IV. gRNAs having a candidate core domain having a selected length, sequence, degree of complementarity, or degree of modification, can be evaluated in the system described at Section IV. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section VIII. However, in an embodiment, the secondary domain comprises one or more modifications, e.g., modifications that it render it less susceptible to degradation or more bio-compatible, e.g., less immunogenic. By way of example, the backbone of the secondary domain can be modified with a phosphorothioate, or other modification(s) from Section VIII. In an embodiment a nucleotide of the secondary domain can comprise a 2' modification, e.g., a 2-acetylation, e.g., a 2' methylation, or other modification(s) from Section VIII. Typically, a secondary domain will contain no more than 1, 2, or 3 modifications.

Modifications in the secondary domain can be selected so as to not interfere with targeting efficacy, which can be evaluated by testing a candidate modification in the system described in Section IV. gRNAs having a candidate secondary domain having a selected length, sequence, degree of complementarity, or degree of modification, can be evaluated in the system described at Section IV. The candidate secondary domain can be placed, either alone, or with one or more other candidate changes in a gRNA molecule/Cas9 molecule system known to be functional with a selected target and evaluated.

In an embodiment, (1) the degree of complementarity between the core domain and its target, and (2) the degree of complementarity between the secondary domain and its target, may differ. In an embodiment, (1) may be greater (2). In an embodiment, (1) may be less than (2). In an embodiment, (1) and (2) may be the same, e.g., each may be completely complementary with its target.

In an embodiment, (1) the number of modification (e.g., modifications from Section VIII) of the nucleotides of the core domain and (2) the number of modification (e.g., modifications from Section VIII) of the nucleotides of the secondary domain, may differ. In an embodiment, (1) may be less than (2). In an embodiment, (1) may be greater than (2). In an embodiment, (1) and (2) may be the same, e.g., each may be free of modifications.

The First and Second Complementarity Domains

The first complementarity domain is complementary with the second complementarity domain.

Typically the first domain does not have exact complementarity with the second complementarity domain target. In some embodiments, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, do not pair in the duplex, and, e.g., form a non-duplexed or looped-out region. In an embodiment an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;

independently, 6, 7, 8, 9, 10, 11, 12, 13, 14, 14, 16, 17, 18, 19, 20, 21, 22, 23, 24, 25, or 26, nucleotides in length;

independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section VIII.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section VIII. In an embodiment a nucleotide of the domain can comprise a 2' modification, e.g., a 2-acetylation, e.g., a 2' methylation, or other modification(s) from Section VIII.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected so as to not interfere with targeting efficacy, which can be evaluated by testing a candidate modification in the system described in Section IV. gRNAs having a candidate complementarity domain having a selected length, sequence, degree of complementarity, or degree of modification, can be evaluated in the system described in Section IV. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 85%, 90% or 95% homology with, or differs by no more than 1, 2, 3, 4, 5, or 6 nucleotides from, a reference first complementarity domain, e.g., a naturally occurring, e.g., an *S. pyogenes, S. aureus* or *S. thermophilus*, first complementarity domain, or a first complementarity domain described herein, e.g., from FIGS. 1A-1G.

In an embodiment, the second complementarity domain has at least 60, 70, 80, 85%, 90%, or 95% homology with, or differs by no more than 1, 2, 3, 4, 5, or 6 nucleotides from, a reference second complementarity domain, e.g., a naturally occurring, e.g., an *S. pyogenes, S. aureus* or *S. thermophilus*, second complementarity domain, or a second complementarity domain described herein, e.g., from FIGS. 1A-1G.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In some embodiments, the first and second complementarity domains, when duplexed, comprise 11 paired nucleotides, for example in the gRNA sequence (one paired strand underlined, one bolded):

(SEQ ID NO: 5)
NNNNNNNNNNNNNNNNNNNNNNGUUUUAGAGCUAGAAAUAGCAAGUUAAAA

UAAGGCUAGUCCGUUAUCAACUUGAAAAAGUGGCACCGAGUCGGUGC.

In some embodiments the first and second complementarity domains, when duplexed, comprise 15 paired nucleotides, for example in the gRNA sequence (one paired strand underlined, one bolded):

(SEQ ID NO: 27)
NNNNNNNNNNNNNNNNNNNNNNGUUUUAGAGCUAUGCUGAAAAGCAUAGCA

AGUUAAAAUAAGGCUAGUCCGUUAUCAACUUGAAAAAGUGGCACCGAGU

CGGUGC.

In some embodiments the first and second complementarity domains, when duplexed, comprise 16 paired nucleotides, for example in the gRNA sequence (one paired strand underlined, one bolded):

(SEQ ID NO: 28)
NNNNNNNNNNNNNNNNNNNNNNNGUUUUAGAGCUAUGCUGGAAACAGCAUAG

CAAGUUAAAAUAAGGCUAGUCCGUUAUCAACUUGAAAAAGUGGCACCGA

GUCGGUGC.

In some embodiments the first and second complementarity domains, when duplexed, comprise 21 paired nucleotides, for example in the gRNA sequence (one paired strand underlined, one bolded):

(SEQ ID NO: 29)
NNNNNNNNNNNNNNNNNNNNNNNGUUUUAGAGCUAUGCUGUUUUGGAAACAA

AACAGCAUAGCAAGUUAAAAUAAGGCUAGUCCGUUAUCAACUUGAAAAA

GUGGCACCGAGUCGGUGC.

In some embodiments, nucleotides are exchanged to remove poly-U tracts, for example in the gRNA sequences (exchanged nucleotides underlined):

(SEQ ID NO: 30)
NNNNNNNNNNNNNNNNNNNNNNNGUA̲UUAGAGCUAGAAAUAGCAAGUUAA̲UA̲

UAAGGCUAGUCCGUUAUCAACUUGAAAAAGUGGCACCGAGUCGGUGC.;

(SEQ ID NO: 31)
NNNNNNNNNNNNNNNNNNNNNNNGUUUA̲AGAGCUAGAAAUAGCAAGUUU̲AAA

UAAGGCUAGUCCGUUAUCAACUUGAAAAAGUGGCACCGAGUCGGUGC.;
or (SEQ ID NO: 32)
NNNNNNNNNNNNNNNNNNNNNNNGUA̲UUAGAGCUAUGCUGUA̲UUGGAAACAA

UA̲CAGCAUAGCAAGUUAA̲UA̲UAAGGCUAGUCCGUUAUCAACUUGAAAAA

GUGGCACCGAGUCGGUGC..

The 5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section VIII. However, in an embodiment, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) from Section VIII. In an embodiment, a nucleotide of the 5' extension domain can comprise a 2' modification, e.g., a 2-acetylation, e.g., a 2' methylation, or other modification(s) from Section VIII.

In some embodiments, the 5' extension domain can comprise as many as 1, 2, 3, 4, 5, 6, 7 or 8 modifications. In an embodiment the 5' extension domain comprises as many as 1, 2, 3, or 4 modifications within 5 nucleotides of its 5' end, e.g., in a modular gRNA molecule. In an embodiment the 5' extension domain comprises as many as 1, 2, 3, or 4 modifications within 5 nucleotides of its 3' end, e.g., in a modular gRNA molecule.

In some embodiments, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in the system described in Section IV. gRNAs having a candidate 5' extension domain having a selected length, sequence, degree of complementarity, or degree of modification, can be evaluated in the system described at Section IV. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 85, 90 or 95% homology with, or differs by no more than 1, 2, 3, 4, 5 or 6 nucleotides from, a reference 5' extension domain, e.g., a naturally occurring, e.g., an *S. pyogenes, S. aureus* or *S. thermophilus,* 5' extension domain, or a 5' extension domain described herein, e.g., from FIGS. 1A-1G.

The Linking Domain

In a unimolecular gRNA molecule, the linking domain is disposed between the first and second complementarity domains. In a modular gRNA molecule, the two molecules are associated with one another by the complementarity domains.

In an embodiment, the linking domain is 10+/−5, 20+/−5, 30+/−5, 40+/−5, 50+/−5, 60+/−5, 70+/−5, 80+/−5, 90+/−5, or 100+1-5 nucleotides, in length.

In an embodiment, the linking domain is 20+/−10, 30+/−10, 40+/−10, 50+/−10, 60+/−10, 70+/−10, 80+/−10, 90+/−10, or 100+/−10 nucleotides in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In and embodiment, the linking domain is a covalent bond.

In an embodiment, the linking domain comprises a duplexed region, typically adjacent to or within 1, 2, or 3 nucleotides of the 3' end of the first complementarity domain and/or the 5-end of the second complementarity domain. In an embodiment, the duplexed region can be 20+/−10 base pairs in length. In an embodiment, the duplexed region can be 10+/−5, 15+/−5, 20+/−5, or 30+/−5 base pairs in length. In an embodiment, the duplexed region can be 1, 2, 3, 4, 5, 6, 7, 8, 9, 10, 11, 12, 13, 14, or 15 base pairs in length.

Typically the sequences forming the duplexed region have exact complementarity with one another, though in some embodiments as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section VIII. However, in an embodiment, the linking domain comprises one or more modifications, e.g., modifications that it render it less susceptible to degradation or more bio-compatible, e.g., less immunogenic. By way of example, the backbone of the linking domain can be modified with a phosphorothioate, or other modification(s) from Section VIII. In an embodiment, a nucleotide of the linking domain can comprise a 2' modification, e.g., a 2-acetylation, e.g., a 2' methylation, or other modification(s) from Section VIII.

In some embodiments, the linking domain can comprise as many as 1, 2, 3, 4, 5, 6, 7 or 8 modifications.

Modifications in a linking domain can be selected so as to not interfere with targeting efficacy, which can be evaluated by testing a candidate modification in the system described in Section IV. gRNAs having a candidate linking domain having a selected length, sequence, degree of complementarity, or degree of modification, can be evaluated a system described in Section IV. A candidate linking domain can be placed, either alone, or with one or more other candidate changes in a gRNA molecule/Cas9 molecule system known to be functional with a selected target and evaluated.

In an embodiment, the linking domain has at least 60, 70, 80, 85, 90 or 95% homology with, or differs by no more than 1, 2, 3, 4, 5 or 6 nucleotides from, a reference linking domain, e.g., a linking domain described herein, e.g., from FIGS. 1A-1G.

The Proximal Domain

In an embodiment, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length. In an embodiment, the proximal domain is 6, 7, 8, 9, 10, 11, 12, 13, 14, 14, 16, 17, 18, 19, 20, 21, 22, 23, 24, 25 or 26 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section VIII. However, in an embodiment, the proximal domain comprises one or more modifications, e.g., modifications that it render it less susceptible to degradation or more bio-compatible, e.g., less immunogenic. By way of example, the backbone of the proximal domain can be modified with a phosphorothioate, or other modification(s) from Section VIII. In an embodiment, a nucleotide of the proximal domain can comprise a 2' modification, e.g., a 2-acetylation, e.g., a 2' methylation, or other modification(s) from Section VIII.

In some embodiments, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In some embodiments, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected so as to not interfere with gRNA molecule efficacy, which can be evaluated by testing a candidate modification in the system described in Section IV. gRNAs having a candidate proximal domain having a selected length, sequence, degree of complementarity, or degree of modification, can be evaluated in the system described at Section IV. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 85 90 or 95% homology with, or differs by no more than 1, 2, 3, 4, 5, or 6 nucleotides from, a reference proximal domain, e.g., a naturally occurring, e.g., an *S. pyogenes, S. aureus* or *S. thermophilus*, proximal domain, or a proximal domain described herein, e.g., from FIGS. 1A-1G.

The Tail Domain

In an embodiment, the tail domain is 10+/−5, 20+/−5, 30+/−5, 40+/−5, 50+/−5, 60+/−5, 70+/−5, 80+/−5, 90+/−5, or 100+1-5 nucleotides in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length.

In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In other embodiments, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 1, 1 to 10, or 1 to 5 nucleotides in length.

In an embodiment, the tail domain nucleotides do not comprise modifications, e.g., modifications of the type provided in Section VIII. However, in an embodiment, the tail domain comprises one or more modifications, e.g., modifications that it render it less susceptible to degradation or more bio-compatible, e.g., less immunogenic. By way of example, the backbone of the tail domain can be modified with a phosphorothioate, or other modification(s) from Section VIII. In an embodiment, a nucleotide of the tail domain can comprise a 2' modification, e.g., a 2-acetylation, e.g., a 2' methylation, or other modification(s) from Section VIII.

In some embodiments, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment, it is 4 to 6 nucleotides in length.

In an embodiment, the tail domain has at least 60, 70, 80, 90 or 95% homology with, or differs by no more than 1, 2, 3, 4, 5 or 6 nucleotides from, a reference tail domain, e.g., a naturally occurring, e.g., an S. pyogenes, S. aureus or S. thermophilus, tail domain, or a tail domain described herein, e.g., from FIGS. 1A-1G.

In an embodiment, the proximal and tail domain, taken together comprise the following sequences:

```
                                              (SEQ ID NO: 33)
AAGGCUAGUCCGUUAUCAACUUGAAAAAGUGGCACCGAGUCGGUGCU,
or (SEQ ID NO: 34)
AAGGCUAGUCCGUUAUCAACUUGAAAAAGUGGCACCGAGUCGGUGGUGC,
or (SEQ ID NO: 35)
AAGGCUAGUCCGUUAUCAACUUGAAAAAGUGGCACCGAGUCGGUGCGGA
UC,
or (SEQ ID NO: 36)
AAGGCUAGUCCGUUAUCAACUUGAAAAAGUG,
or (SEQ ID NO: 37)
AAGGCUAGUCCGUUAUCA,
or (SEQ ID NO: 38)
AAGGCUAGUCCG.
```

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e., if a pol-II promoter is used to drive transcription.

Modifications in the tail domain can be selected so as to not interfere with targeting efficacy, which can be evaluated by testing a candidate modification in the system described in Section IV. gRNAs having a candidate tail domain having a selected length, sequence, degree of complementarity, or degree of modification, can be evaluated in the system described in Section IV. The candidate tail domain can be placed, either alone, or with one or more other candidate changes in a gRNA molecule/Cas9 molecule system known to be functional with a selected target and evaluated.

In some embodiments, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment, a gRNA has the following structure:
5' [targeting domain]-[first complementarity domain]-[linking domain]-[second complementarity domain]-[proximal domain]-[tail domain]-3',
wherein the targeting domain comprises a core domain and, optionally, a secondary domain, and is 10 to 50 nucleotides in length;
the first complementarity domain is 5 to 25 nucleotides in length and, in an embodiment, has at least 50, 60, 70, 80, 85, 90 or 95% homology with a reference first complementarity domain disclosed herein;
the linking domain is 1 to 5 nucleotides in length;
the second complementarity domain is 5 to 27 nucleotides in length and, in an embodiment has at least 50, 60, 70, 80, 85, 90 or 95% homology with a reference second complementarity domain disclosed herein;
the proximal domain is 5 to 20 nucleotides in length and, in an embodiment has at least 50, 60, 70, 80, 85, 90 or 95% homology with a reference proximal domain disclosed herein;
and the tail domain is absent or a nucleotide sequence is 1 to 50 nucleotides in length and, in an embodiment, has at least 50, 60, 70, 80, 85, 90 or 95% homology with a reference tail domain disclosed herein.

Exemplary Chimeric gRNAs

In an embodiment, a unimolecular, or chimeric, gRNA comprises, preferably from 5' to 3':
 a targeting domain (which is complementary to a target nucleic acid);
 a first complementarity domain, e.g., comprising 15, 16, 17, 18, 19, 20, 21, 22, 23, 24, 25, or 26 nucleotides;
 a linking domain;
 a second complementarity domain (which is complementary to the first complementarity domain);
 a proximal domain; and
 a tail domain,
 wherein,
 (a) the proximal and tail domain, when taken together, comprise at least 15, 18, 20, 25, 30, 31, 35, 40, 45, 49, 50, or 53 nucleotides;
 (b) there are at least 15, 18, 20, 25, 30, 31, 35, 40, 45, 49, 50, or 53 nucleotides 3' to the last nucleotide of the second complementarity domain; or
 (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGAGCUAGAAAUAGCAAGUUAAAAUAAGG CUAGUCCGUUAUCAACUUGAAAAAGUGGCACCGAGUCGGUGC (SEQ ID NO:429). In an embodiment, the unimolecular, or chimeric, gRNA molecule is a S. pyogenes gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGUACUCUGGAAACAGAAUCUACUAAAAC AAGGCAAAAUGCCGUGUUUAUCUCGUCAACUUGUUGGCGAGA (SEQ ID NO:430). In an embodiment, the unimolecular, or chimeric, gRNA molecule is a S. aureus gRNA molecule.

Exemplary Modular gRNAs

In an embodiment, a modular gRNA comprises:
a first strand comprising, preferably from 5' to 3';
  a targeting domain, e.g., comprising 15, 16, 17, 18, 19, 20, 21, 22, 23, 24, 25, or 26 nucleotides;
  a first complementarity domain; and
a second strand, comprising, preferably from 5' to 3';
  optionally a 5' extension domain;
  a second complementarity domain;
  a proximal domain; and
  a tail domain,
wherein:
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

II. Methods for Designing gRNAs

Methods for designing gRNAs are described herein, including methods for selecting, designing and validating target domains. Exemplay targeting domains are also provided herein. Targeting Domains discussed herein can be incorporated into the gRNAs described herein.

Methods for selection and validation of target sequences as well as off-target analyses are described, e.g., in Mali et al., SCIENCE 2013, 339(6121): 823-826; Hsu et al., NAT BIOTECHNOL, published on Jul. 21, 2013; Fu et al., NAT BIOTECHNOL 2014 Jan. 26 (doi: 10.1038/nbt.2808. PubMed PMID: 24463574); Heigwer et al., NAT METHODS 2014, 11(2): 122-3 (doi: 10.1038/nmeth.2812. PubMed PMID: 24481216); Bae et al., BIOINFORMATICS, 2014 Jan. 24 (PubMed PMID: 24463181); Xiao A et al., BIOINFORMATICS, 2014 Jan. 21 (PubMed PMID: 243 89662).

For example, a software tool can be used to optimize the choice of gRNA within a user's target sequence, e.g., to minimize total off-target activity across the genome. Off target activity may be other than cleavage. For each possible gRNA choice, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described in Section IV herein.

Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference: Cas-OFFinder: a fast and versatile algorithm that searches for potential off-target sites of Cas9 RNA-guided endonucleases., *Bioinformatics*. 2014 Feb. 17. Bae S1, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relavant PAM, e.g., in the case of *S. pyogenes*, a NGG PAM, in the case of *S. aureus*, NNGRR (e.g, a NNGRRT or NNGRRV) PAM, and in the case of *N. meningitides*, a NNNNGATT or NNNNGCTT PAM. Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitides* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 1-3, 4A-4E, 5A-5F, or 6A-6D, e.g., the targeting domains of 18 or more nucleotides may comprise the 17-mer gRNAs described in Tables 1-3, 4A-4E, 5A-5F, or 6A-6D. Targeting domains, disclosed herein, may comprises the 18-mer described in Tables 1-3, 4A-4E, 5A-5F, or 6A-6D, e.g., the targeting domains of 19 or more nucleotides may comprise the 18-mer gRNAs described in Tables 1-3, 4A-4E, 5A-5F, or 6A-6D. Targeting domains, disclosed herein, may comprises the 19-mer described in Tables 1-3, 4A-4E, 5A-5F, or 6A-6D, e.g., the targeting domains of 20 or more nucleotides may comprise the 19-mer gRNAs described in Tables 1-3, 4A-4E, 5A-5F, or 6A-6D. Targeting domains, disclosed herein, may comprises the 20-mer gRNAs described in Tables 1-3, 4A-4E, 5A-5F, or 6A-6D, e.g., the targeting domains of 21 or more nucleotides may comprise the 20-mer gRNAs described in Tables 1-3, 4A-4E, 5A-5F, or 6A-6D. Targeting domains, disclosed herein, may comprises the 21-mer described in Tables 1-3, 4A-4E, 5A-5F, or 6A-6D, e.g., the targeting domains of 22 or more nucleotides may comprise the 21-mer gRNAs described in Tables 1-3, 4A-4E, 5A-5F, or 6A-6D. Targeting domains, disclosed herein, may comprises the 22-mer described in Tables 1-3, 4A-4E, 5A-5F, or 6A-6D, e.g., the targeting domains of 23 or more nucleotides may comprise the 22-mer gRNAs described in Tables 1-3, 4A-4E, 5A-5F, or 6A-6D. Targeting domains, disclosed herein, may comprises the 23-mer described in Tables 1-3, 4A-4E, 5A-5F, or 6A-6D, e.g., the targeting domains of 24 or more nucleotides may comprise the 23-mer gRNAs described in Tables 1-3, 4A-4E, 5A-5F, or 6A-6D. Targeting domains, disclosed herein, may comprises the 24-mer described in Tables 1-3, 4A-4E, 5A-5F, or 6A-6D, e.g., the targeting domains of 25 or more nucleotides may comprise the 24-mer gRNAs described in Tables 1-3, 4A-4E, 5A-5F, or 6A-6D.

gRNAs were identified for both single-gRNA nuclease cleavage and for a dual-gRNA paired "nickase" strategy. Criteria for selecting gRNAs and for determining which gRNAs are used in a selected strategy is based on several considerations:

1. gRNA pairs should be oriented on the DNA such that PAMs are facing out and cutting with the D10A Cas9 nickase will result in 5' overhangs.
2. An assumption that cleaving with dual nickase pairs results in deletion of the entire intervening sequence at a reasonable frequency. However, use of dual nickase pairs also typically results in indel mutations at the site of only one of the gRNAs. Candidate pair members can be tested to determine how efficiently they remove the entire sequence versus producing indel mutations at the site of one gRNA.

The targeting domains discussed herein can be incorporated into the gRNAs described herein.

As an example, two strategies were utilized to identify gRNAs for use with *S. pyogenes, S. aureus* and *N. meningitidis* Cas9 enzymes.

In one strategy, gRNAs were designed for use with *S. pyogenes* Cas9 enzymes (Tables 1-3). While it can be desirable to have gRNAs start with a 5'G, this requirement was relaxed for some gRNAs in tier 1 to identify guides in the correct orientation, within a reasonable distance to the mutation and with a high level of orthogonality. To find a pair of gRNAs for the dual-nickase strategy, the distance from the mutation was extended or the requirement for the 5'G was removed. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

As discussed above, gRNAs were identified for single-gRNA nuclease cleavage as well as for a dual-gRNA paired "nickase" strategy, as indicated.

In a second strategy, gRNAs were designed for use with *S. pyogenes*, *S. aureus* and *N. meningitidis* Cas9 enzymes. The gRNAs were identified and ranked into 4 tiers for *S. pyogenes* (Tables 4A-4E). The targeting domain to be used with *S. pyogenes* Cas9 enzymes for tier 1 gRNA molecules were selected based on (1) proximity to the mutation, e.g., within 200 bp (e.g., upstream or downstream) of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 5 tiers for *S. aureus*, when the relevant PAM was NNGRRT or NNGRRV (Tables 5A-5F). The targeting domain to be used with *S. aureus* Cas9 enzymes for tier 1 gRNA molecules were selected based on (1) proximity to the mutation, e.g., within 200 bp (e.g., upstream or downstream) of mutation, (2) a high level of orthogonality, (3) the presence of a 5' G and (4) PAM was NNGRRT. For selection of tier 2 gRNAs, a reasonable distance and high orthogonality were required but the presence of a 5'G was not required, and PAM was NNGRRT. Tier 3 uses the same distance restriction and the requirement for a 5'G, but removes the requirement of good orthogonality, and PAM was NNGRRT. Tier 4 uses the same distance restriction but removes the requirement of good orthogonality and the 5'G, and PAM was NNGRRT. Tier 5 uses the same distance restriction but removes the requirement of good orthogonality and the 5'G, and PAM was NNGRRV. The gRNAs were identified and ranked into 4 tiers for *N. meningitides* (Tables 6A-6D). The targeting domain to be used with *N. meningitides* Cas9 enzymes for tier 1 gRNA molecules were selected based on (1) proximity to the mutation, e.g., within 200 bp (e.g., upstream or downstream) of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. Note that tiers are non-inclusive (each gRNA is listed only once for the strategy). In certain instances, no gRNA was identified based on the criteria of the particular tier.

In an embodiment, when a single gRNA molecule is used to target a Cas9 nickase to create a single strand break in close proximity to the mutation, eg., the gRNA is used to target either upstream of (e.g., within 200 bp upstream of the mutation), or downstream of (e.g., within 200 bp downstream of the mutation) in the USH2A gene.

In an embodiment, when a single gRNA molecule is used to target a Cas9 nuclease to create a double strand break to in close proximity to the mutation, e.g., the gRNA is used to target either upstream of (e.g., within 200 bp upstream of the mutation), or downstream of (e.g., within 200 bp downstream of the mutation) in the USH2A gene.

In an embodiment, dual targeting is used to create two double strand breaks to in close proximity to the mutation, e.g., the gRNA is used to target either upstream of (e.g., within 200 bp upstream of the mutation), or downstream of (e.g., within 200 bp downstream of the mutation) in the USH2A gene. In an embodiment, the first and second gRNAs are used target two Cas9 nucleases to flank, e.g., the first of gRNA is used to target upstream of (e.g., within 200 bp upstream of the mutation), and the second gRNA is used to target downstream of (e.g., within 200 bp downstream of the mutation) in the USH2Agene.

In an embodiment, dual targeting is used to create a double strand break and a pair of single strand breaks to delete a genomic sequence including the mutation. In an embodiment, the first, second and third gRNAs are used to target one Cas9 nuclease and two Cas9 nickases to flank, e.g., the first gRNA that will be used with the Cas9 nuclease is used to target upstream of (e.g., within 200 bp upstream of the mutation) or downstream of (e.g., within 200 bp downstream of the mutation), and the second and third gRNAs that will be used with the Cas9 nickase pair are used to target the opposite side of the mutation (e.g., within 200 bp upstream or downstream of the mutation) in the USH2A gene.

In an embodiment, when four gRNAs (e.g., two pairs) are used to target four Cas9 nickases to create four single strand breaks to delete genomic sequence including the mutation, the first pair and second pair of gRNAs are used to target four Cas9 nickases to flank, e.g., the first pair of gRNAs are used to target upstream of (e.g., within 200 bp upstream of the mutation), and the second pair of gRNAs are used to target downstream of (e.g., within 200 bp downstream of the mutation) in the USH2A gene.

Any of the targeting domains in the tables described herein can be used with a Cas9 nickase molecule to generate a single strand break.

Any of the targeting domains in the tables described herein can be used with a Cas9 nuclease molecule to generate a double strand break.

In an embodiment, dual targeting (e.g., dual nicking) is used to create two nicks on opposite DNA strands by using *S. pyogenes*, *S. aureus* and *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs including selecting a targeting domain from Group A and a second targeting domain from Group B, or selecting a targeting domain from Group C and a second targeting domain from Group D, in Table 4E (for *S. pyogenes*), selecting a targeting domain from Group A and a second targeting domain from Group B in Table 5F (for *S. aureus*) or selecting a targeting domain from Group A and a second targeting domain from Group B in Table 6D (for *N. meningitidis*). It is contemplated herein that in an embodiment a targeting domain of Group A can be combined with any of the targeting domains of Group B, or a targeting domain of Group C can be combined with any of the targeting domains of Group D in Table 4E (for *S. pyogenes*). For example, USH2A-182 can be combined with USH2A-179, USH2A-177 can be combined with USH2A-176, or USH2A-187 can be combined with USH2A-176. It is contemplated herein that in an embodiment a targeting domain of Group A can be combined with any of the targeting domains of Group B in Table 5F (for *S. aureus*). For example, USH2A-288 can be combined with USH2A-448. It is contemplated herein that in an embodiment a targeting domain of Group A can be combined with any of the targeting domains of Group B in Table 6D (for *N. meningitidis*). For example, USH2A-266 can be combined with USH2A-261 or USH2A-268 can be combined with USH2A-261.

When two gRNAs designed for use to target two Cas9 molecules, one Cas9 can be one species, the second Cas9 can be from a different species. Both Cas9 species are used to generate a single or double-strand break, as desired.

Exemplary Targeting Domains

Table 1 provides targeting domains for the 2299delG site selected according to first tier parameters, and are selected based on the presence of a 5' G, close proximity and orientation to mutation and orthogonality in the human genome. In an embodiment, the targeting domain is the exact complement of the target domain. Any of the targeting domains can be used with a Cas9 molecule that gives double stranded cleavage. Any of the targeting domains in the table can be used with single-stranded break nucleases (nickases). In an embodiment, dual targeting is used to create two nicks. In an embodiment, 20-mer dual nickase pairs are used, e.g., USH2A-1 and USH2A-6, or USH2A-2 and USH2A-6 are used. In an embodiment, 17-mer dual nickase pairs are used, e.g., USH2A-15 and USH2A-20, USH2A-15 and USH2A-22, USH2A-16 and USH2A-20, or USH2A-16 and USH2A-22 are used.

TABLE 1

1st Tier selected based on the presence of a 5' G (only for USH2A-1, 2, 5, 6, 10, 11), close proximity and orientation to mutation and orthogonality in the human genome

| gRNA Name | DNA Strand | Target Site Sequence (does not include PAM) | Target Site Length | Distance to mutation |
|---|---|---|---|---|
| USH2A-1 | − | GAGUGCAAAAAAGAAGCCAA (SEQ ID NO: 392) | 20 | 16 bp downstream |
| USH2A-2 | − | GUUAGAUGUCACCAAUUGUA (SEQ ID NO: 393) | 20 | 75 bp downstream |
| USH2A-5 | + | GGUGUCACACUGAAGUCCUU (SEQ ID NO: 394) | 20 | 21 bp downstream |
| USH2A-6 | + | GCCAUGGAGGUUACACUGGC (SEQ ID NO: 395) | 20 | 56 bp upstream |
| USH2A-10 | + | GUCACAGGCCUUACAAU (SEQ ID NO: 396) | 17 | 75 bp downstream |
| USH2A-11 | + | GUCACACUGAAGUCCUU (SEQ ID NO: 397) | 17 | 21 bp downstream |
| USH2A-15 | − | UGCAAAAAAGAAGCCAA (SEQ ID NO: 398) | 17 | 16 bp downstream |
| USH2A-16 | − | UGCAGAGAAAACUUUUA (SEQ ID NO: 399) | 17 | 52 bp downstream |
| USH2A-20 | + | UGUUCACUGAGCCAUGG (SEQ ID NO: 400) | 17 | 43 bp upstream |
| USH2A-22 | + | AUGGAGGUUACACUGGC (SEQ ID NO: 401) | 17 | 56 bp upstream |

Table 2 provides targeting domains for the 2299delG site selected according to Second Tier parameters, as described above, and are selected based on the presence of a 5' G and reasonable proximity to mutation.

TABLE 2

2nd Tier — Selected based on the presence of a 5' G and reasonable proximity to mutation

| gRNA Name | DNA Strand | Target Site Sequence (does not include PAM) | Target Site Length |
|---|---|---|---|
| USH2A-3 | − | GCCUGUGACUGUGACACAGC (SEQ ID NO: 412) | 20 |
| USH2A-4 | − | GACACAGCUGGAUCCCUCCC (SEQ ID NO: 407) | 20 |
| USH2A-7 | − | GCAGAGAAAACUUUUAU (SEQ ID NO: 443) | 17 |

TABLE 2-continued

Selected based on the presence of a 5' G
2nd Tier and reasonable proximity to mutation

| gRNA Name | DNA Strand | Target Site Sequence (does not include PAM) | Target Site Length |
|---|---|---|---|
| USH2A-8 | − | GUCUGUAAUGCUAAGAC (SEQ ID NO: 406) | 17 |
| USH2A-9 | + | GCAUUACAGACAGUCCC (SEQ ID NO: 403) | 17 |

Table 3 provides targeting domains for the 2299delG site selected according to Third Tier parameters, as described above, and are selected based on reasonable proximity to mutation.

TABLE 3

Selected based
3rd Tier on reasonable proximity to mutation

| gRNA Name | DNA Strand | Target Site Sequence (does not include PAM) | Target Site Length |
|---|---|---|---|
| USH2A-12 | − | UGCCAGUGUAACCUCCA (SEQ ID NO: 446) | 17 |
| USH2A-13 | − | UUCUGCAAUCCUCACUC (SEQ ID NO: 447) | 17 |
| USH2A-14 | − | UCUGCAAUCCUCACUCU (SEQ ID NO: 448) | 17 |
| USH2A-17 | + | AUAAAAGUUUUCUCUGC (SEQ ID NO: 449) | 17 |
| USH2A-18 | + | UCACACUGCCCAGAGUG (SEQ ID NO: 450) | 17 |
| USH2A-19 | + | AUUUGUUCACUGAGCCA (SEQ ID NO: 451) | 17 |
| USH2A-21 | + | AGCCAUGGAGGUUACAC (SEQ ID NO: 452) | 17 |
| USH2A-23 | + | CUACACUGCCCAGAGUG (SEQ ID NO: 453) | 17 |
| USH2A-24 | − | AAAUUCUGCAAUCCUCACUC (SEQ ID NO: 454) | 20 |
| USH2A-25 | − | AAUUCUGCAAUCCUCACUCU (SEQ ID NO: 455) | 20 |
| USH2A-26 | − | ACACAGCUGGAUCCCUCCCU (SEQ ID NO: 456) | 20 |
| USH2A-27 | − | ACCUGCAGAGAAAACUUUUA (SEQ ID NO: 457) | 20 |
| USH2A-28 | − | ACUGUCUGUAAUGCUAAGAC (SEQ ID NO: 458) | 20 |
| USH2A-29 | − | AGGUGUGAUCAUUGCAAUUU (SEQ ID NO: 459) | 20 |
| USH2A-30 | − | AUAUUUUAUCUUUAGGGCUU (SEQ ID NO: 460) | 20 |
| USH2A-31 | − | CCCUGCCAGUGUAACCUCCA (SEQ ID NO: 461) | 20 |
| USH2A-32 | − | CCUGCAGAGAAAACUUUUAU (SEQ ID NO: 462) | 20 |

TABLE 3-continued

Selected based
3rd Tier on reasonable proximity to mutation

| gRNA Name | DNA Strand | Target Site Sequence (does not include PAM) | Target Site Length |
|---|---|---|---|
| USH2A-33 | − | CUCCGAAGCUUUAAUGAUGU (SEQ ID NO: 463) | 20 |
| USH2A-34 | − | CUGUCUGUAAUGCUAAGACA (SEQ ID NO: 464) | 20 |
| USH2A-35 | + | ACAGUCACAGGCCUUACAAU (SEQ ID NO: 465) | 20 |
| USH2A-36 | + | AGAAUUUGUUCACUGAGCCA (SEQ ID NO: 466) | 20 |
| USH2A-37 | + | AUCCAACAUCAUUAAAGCUU (SEQ ID NO: 467) | 20 |
| USH2A-38 | + | AUUACAGACAGUCCCAGGGA (SEQ ID NO: 468) | 20 |
| USH2A-39 | + | AUUUGUUCACUGAGCCAUGG (SEQ ID NO: 469) | 20 |
| USH2A-40 | + | CACUCACACUGCCCAGAGUG (SEQ ID NO: 470) | 20 |
| USH2A-41 | + | CAUUACAGACAGUCCCAGGG (SEQ ID NO: 471) | 20 |
| USH2A-42 | + | CCAUGGAGGUUACACUGGCA (SEQ ID NO: 472) | 20 |
| USH2A-43 | + | CCCAUAAAAGUUUUCUCUGC (SEQ ID NO: 473) | 20 |
| USH2A-44 | + | CUGAGCCAUGGAGGUUACAC (SEQ ID NO: 474) | 20 |
| USH2A-45 | + | UAGCAUUACAGACAGUCCCA (SEQ ID NO: 475) | 20 |
| USH2A-46 | + | UCCAGCUGUGUCACAGUCAC (SEQ ID NO: 476) | 20 |
| USH2A-47 | + | UUAGCAUUACAGACAGUCCC (SEQ ID NO: 477) | 20 |
| USH2A-48 | − | AAUAUAUUUUAUCUUUA (SEQ ID NO: 478) | 17 |
| USH2A-49 | − | UUUUAUCUUUAGGGCUU (SEQ ID NO: 479) | 17 |
| USH2A-50 | − | UGUGAUCAUUGCAAUUU (SEQ ID NO: 480) | 17 |
| USH2A-51 | − | CGAAGCUUUAAUGAUGU (SEQ ID NO: 481) | 17 |
| USH2A-52 | − | AGAUGUCACCAAUUGUA (SEQ ID NO: 482) | 17 |
| USH2A-53 | − | UGUGACUGUGACACAGC (SEQ ID NO: 483) | 17 |
| USH2A-54 | − | ACAGCUGGAUCCCUCCC (SEQ ID NO: 484) | 17 |
| USH2A-55 | − | CAGCUGGAUCCCUCCCU (SEQ ID NO: 485) | 17 |
| USH2A-56 | − | UCUGUAAUGCUAAGACA (SEQ ID NO: 486) | 17 |

TABLE 3-continued

3rd Tier Selected based on reasonable proximity to mutation

| gRNA Name | DNA Strand | Target Site Sequence (does not include PAM) | Target Site Length |
|---|---|---|---|
| USH2A-57 | + | CAUUACAGACAGUCCCA (SEQ ID NO: 487) | 17 |
| USH2A-58 | + | UACAGACAGUCCCAGGG (SEQ ID NO: 488) | 17 |
| USH2A-59 | + | ACAGACAGUCCCAGGGA (SEQ ID NO: 489) | 17 |
| USH2A-60 | + | AGCUGUGUCACAGUCAC (SEQ ID NO: 490) | 17 |
| USH2A-61 | + | UGGAGGUUACACUGGCA (SEQ ID NO: 491) | 17 |
| USH2A-62 | + | CAACAUCAUUAAAGCUU (SEQ ID NO: 492) | 17 |

Table 4A provides targeting domains for the 2299delG site in the USH2A gene selected according to the first tier parameters. The targeting domains are within 200 bases of the 2299deG site, have good orthogonality, and start with G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 4A

| gRNA Name | DNA Strand | Targeting Domain | Target Site Length |
|---|---|---|---|
| USH2A-230 | − | GCAAGCCCAAUGUUGAA (SEQ ID NO: 402) | 17 |
| USH2A-225 | + | GCAUUACAGACAGUCCC (SEQ ID NO: 403) | 17 |
| USH2A-221 | + | GUCACACUGAAGUCCUU (SEQ ID NO: 397) | 17 |
| USH2A-217 | + | GUCACAGGCCUUACAAU (SEQ ID NO: 396) | 17 |
| USH2A-226 | − | GUCUGUAAUGCUAAGAC (SEQ ID NO: 406) | 17 |
| USH2A-198 | − | GACACAGCUGGAUCCCUCCC (SEQ ID NO: 407) | 20 |
| USH2A-204 | − | GAGACAGUGCAAUAAAUGUU (SEQ ID NO: 408) | 20 |
| USH2A-184 | + | GCACUACACUGCCCAGAGUG (SEQ ID NO: 409) | 20 |
| USH2A-197 | + | GCACUGUCUCCCUUCAACAU (SEQ ID NO: 410) | 20 |
| USH2A-194 | + | GCCAUGGAGGUUACACUGGC (SEQ ID NO: 395) | 20 |
| USH2A-192 | − | GCCUGUGACUGUGACACAGC (SEQ ID NO: 412) | 20 |
| USH2A-188 | + | GGUGUCACACUGAAGUCCUU (SEQ ID NO: 394) | 20 |

TABLE 4A-continued

| gRNA Name | DNA Strand | Targeting Domain | Target Site Length |
|---|---|---|---|
| USH2A-179 | − | GUUAGAUGUCACCAAUUGUA (SEQ ID NO: 393) | 20 |

Table 4B provides targeting domains for the 2299delG site in the USH2A gene selected according to the second tier parameters. The targeting domains are within 200 bases of the 2299deG site, have good orthogonality, and do not start with G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 4B

| gRNA Name | DNA Strand | Targeting Domain | Target Site Length |
|---|---|---|---|
| USH2A-244 | − | ACAGCUGGAUCCCUCCC (SEQ ID NO: 484) | 17 |
| USH2A-237 | − | ACAGUGCAAUAAAUGUU (SEQ ID NO: 507) | 17 |
| USH2A-220 | − | AGAUGUCACCAAUUGUA (SEQ ID NO: 482) | 17 |
| USH2A-231 | + | AGCCAUGGAGGUUACAC (SEQ ID NO: 452) | 17 |
| USH2A-241 | + | AUAAAAGUUUUCUCUGC (SEQ ID NO: 449) | 17 |
| USH2A-219 | + | AUGGAGGUUACACUGGC (SEQ ID NO: 401) | 17 |
| USH2A-247 | + | AUUUAAAAGGUGAGGAU (SEQ ID NO: 512) | 17 |
| USH2A-245 | + | AUUUGUUCACUGAGCCA (SEQ ID NO: 451) | 17 |
| USH2A-242 | + | CAACAUCAUUAAAGCUU (SEQ ID NO: 492) | 17 |
| USH2A-228 | − | CAGCUGGAUCCCUCCCU (SEQ ID NO: 485) | 17 |
| USH2A-222 | + | CAUUACAGACAGUCCCA (SEQ ID NO: 487) | 17 |
| USH2A-218 | − | CGAAGCUUUAAUGAUGU (SEQ ID NO: 481) | 17 |
| USH2A-235 | + | CUACACUGCCCAGAGUG (SEQ ID NO: 453) | 17 |
| USH2A-234 | + | CUGUCUCCCUUCAACAU (SEQ ID NO: 519) | 17 |
| USH2A-232 | + | UACAGACAGUCCCAGGG (SEQ ID NO: 488) | 17 |
| USH2A-229 | − | UCUGCAAUCCUCACUCU (SEQ ID NO: 448) | 17 |
| USH2A-224 | − | UCUGUAAUGCUAAGACA (SEQ ID NO: 486) | 17 |
| USH2A-240 | − | UGCAAGCCCAAUGUUGA (SEQ ID NO: 523) | 17 |

TABLE 4B-continued

| gRNA Name | DNA Strand | Targeting Domain | Target Site Length |
|---|---|---|---|
| USH2A-246 | − | UGCAGAGAAAACUUUUA (SEQ ID NO: 399) | 17 |
| USH2A-233 | − | UGCCAGUGUAACCUCCA (SEQ ID NO: 446) | 17 |
| USH2A-227 | + | UGGAGGUUACACUGGCA (SEQ ID NO: 491) | 17 |
| USH2A-223 | + | UGUCUCCCUUCAACAUU (SEQ ID NO: 527) | 17 |
| USH2A-238 | − | UGUGAUCAUUGCAAUUU (SEQ ID NO: 480) | 17 |
| USH2A-239 | + | UGUUCACUGAGCCAUGG (SEQ ID NO: 400) | 17 |
| USH2A-236 | − | UUCUGCAAUCCUCACUC (SEQ ID NO: 447) | 17 |
| USH2A-243 | − | UUUUAUCUUUAGGGCUU (SEQ ID NO: 479) | 17 |
| USH2A-178 | − | AAAUUCUGCAAUCCUCACUC (SEQ ID NO: 454) | 20 |
| USH2A-186 | − | AAUUCUGCAAUCCUCACUCU (SEQ ID NO: 455) | 20 |
| USH2A-191 | − | ACACAGCUGGAUCCCUCCCU (SEQ ID NO: 456) | 20 |
| USH2A-175 | + | ACAGUCACAGGCCUUACAAU (SEQ ID NO: 465) | 20 |
| USH2A-206 | − | ACAGUGCAAUAAAUGUUUGG (SEQ ID NO: 536) | 20 |
| USH2A-201 | − | ACCUGCAGAGAAAACUUUUA (SEQ ID NO: 457) | 20 |
| USH2A-196 | − | ACUGUCUGUAAUGCUAAGAC (SEQ ID NO: 458) | 20 |
| USH2A-199 | + | AGAAUUGUUCACUGAGCCA (SEQ ID NO: 466) | 20 |
| USH2A-185 | − | AGGUGUGAUCAUUGCAAUUU (SEQ ID NO: 459) | 20 |
| USH2A-193 | − | AUAUUUUAUCUUUAGGGCUU (SEQ ID NO: 460) | 20 |
| USH2A-202 | + | AUCCAACAUCAUUAAAGCUU (SEQ ID NO: 467) | 20 |
| USH2A-176 | − | AUCUGCAAGCCCAAUGUUGA (SEQ ID NO: 543) | 20 |
| USH2A-205 | + | AUUACAGACAGUCCCAGGGA (SEQ ID NO: 468) | 20 |
| USH2A-200 | + | CACUGUCUCCCUUCAACAUU (SEQ ID NO: 545) | 20 |
| USH2A-203 | − | CAGUGCAAUAAAUGUUUGGA (SEQ ID NO: 546) | 20 |
| USH2A-177 | + | CAUUACAGACAGUCCCAGGG (SEQ ID NO: 471) | 20 |
| USH2A-180 | + | CCAUGGAGGUUACACUGGCA (SEQ ID NO: 472) | 20 |
| USH2A-182 | + | CCCAUAAAAGUUUUCUCUGC (SEQ ID NO: 473) | 20 |
| USH2A-183 | − | CCCUGCCAGUGUAACCUCCA (SEQ ID NO: 461) | 20 |
| USH2A-174 | − | CUCCGAAGCUUUAAUGAUGU (SEQ ID NO: 463) | 20 |
| USH2A-189 | + | CUGAGCCAUGGAGGUUACAC (SEQ ID NO: 474) | 20 |
| USH2A-181 | − | CUGUCUGUAAUGCUAAGACA (SEQ ID NO: 464) | 20 |
| USH2A-187 | + | UAGCAUUACAGACAGUCCCA (SEQ ID NO: 475) | 20 |
| USH2A-190 | − | UCUGCAAGCCCAAUGUUGAA (SEQ ID NO: 555) | 20 |
| USH2A-195 | + | UUAGCAUUACAGACAGUCCC (SEQ ID NO: 477) | 20 |

Table 4C provides targeting domains for the 2299delG site in the USH2A gene selected according to the third tier parameters. The targeting domains are within 200 bases of the 2299deG site, and start with G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 4C

| gRNA Name | DNA Strand | Targeting Domain | Target Site Length |
|---|---|---|---|
| USH2A-259 | + | GAUAAAAUAUAUUUAAA (SEQ ID NO: 557) | 17 |
| USH2A-249 | − | GCAGAGAAAACUUUUAU (SEQ ID NO: 443) | 17 |
| USH2A-255 | − | GUGCAAUAAAUGUUUGG (SEQ ID NO: 559) | 17 |

Table 4D provides targeting domains for the 2299delG site in the USH2A gene selected according to the fourth tier parameters. The targeting domains are within 200 bases of the 2299deG site. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 4D

4th Tier

| gRNA Name | DNA Strand | Targeting Domain | Target Site Length |
|---|---|---|---|
| USH2A-258 | − | AAAUAUAUUUUAUCUUU (SEQ ID NO: 560) | 17 |

TABLE 4D-continued

4th Tier

| gRNA Name | DNA Strand | Targeting Domain | Target Site Length |
|---|---|---|---|
| USH2A-257 | + | AAUAUAUUUAAAAGGUG (SEQ ID NO: 561) | 17 |
| USH2A-253 | − | AAUAUAUUUAUCUUUA (SEQ ID NO: 478) | 17 |
| USH2A-251 | + | ACAGACAGUCCCAGGGA (SEQ ID NO: 489) | 17 |
| USH2A-254 | + | AGCUGUGUCACAGUCAC (SEQ ID NO: 490) | 17 |
| USH2A-252 | + | UAUUUAAAAGGUGAGGA (SEQ ID NO: 565) | 17 |
| USH2A-256 | − | UGCAAAAAAGAAGCCAA (SEQ ID NO: 398) | 17 |
| USH2A-248 | − | UGCAAUAAAUGUUUGGA (SEQ ID NO: 567) | 17 |
| USH2A-250 | − | UGUGACUGUGACACAGC (SEQ ID NO: 483) | 17 |
| USH2A-216 | + | AAAGAUAAAAUAUAUUUAAA (SEQ ID NO: 569) | 20 |
| USH2A-208 | + | AUAUAUUUAAAAGGUGAGGA (SEQ ID NO: 570) | 20 |
| USH2A-210 | + | AUUUGUUCACUGAGCCAUGG (SEQ ID NO: 469) | 20 |
| USH2A-211 | − | CCUGCAGAGAAAACUUUUAU (SEQ ID NO: 462) | 20 |
| USH2A-209 | + | UAAAAUAUAUUUAAAAGGUG (SEQ ID NO: 573) | 20 |
| USH2A-212 | − | UAGUGCAAAAAGAAGCCAA (SEQ ID NO: 574) | 20 |
| USH2A-207 | + | UAUAUUUAAAAGGUGAGGAU (SEQ ID NO: 575) | 20 |
| USH2A-215 | + | UCCAGCUGUGUCACAGUCAC (SEQ ID NO: 476) | 20 |
| USH2A-213 | − | UUAAAUAUAUUUAUCUUUA (SEQ ID NO: 577) | 20 |
| USH2A-214 | − | UUUAAAUAUAUUUAUCUUU (SEQ ID NO: 578) | 20 |

Table 4E provides targeting domains for the 2299delG site in the USH2A gene that can be used for dual targeting. Any of the targeting domains in the table can be used with a *S. pyogenes* Cas9 (nickase) molecule to generate a single stranded break.

Exemplary nickase pairs including selecting a targeting domain from Group A and a second targeting domain from Group B, or a targeting domain from Group C and a second targeting domain from Group D. It is contemplated herein that in an embodiment a targeting domain of Group A can be combined with any of the targeting domains of Group B or a targeting domain of Group C can be combined with any of the targeting domains of Group D. For example, USH2A-182 can be combined with USH2A-179, USH2A-177 can be combined with USH2A-176, or USH2A-187 can be combined with USH2A-176.

TABLE 4E

| Group A | Group B | Group C | Group D |
|---|---|---|---|
| USH2A-182 (SEQ ID NO: 473) | USH2A-179 (SEQ ID NO: 393) | USH2A-177 USH2A-187 (SEQ ID NO: 475) | USH2A-176 (SEQ ID NO: 543) |

Table 5A provides targeting domains for the 2299delG site in the USH2A selected according to the first tier parameters. The targeting domains are within 200 bases of the 2299deG site, have good orthogonality, start with G and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5A

| gRNA Name | DNA Strand | Targeting Domain | Target Site Length |
|---|---|---|---|
| USH2A-292 | + | GCACUACACUGCCCAGAGU (SEQ ID NO: 415) | 19 |
| USH2A-298 | − | GCCUGUGACUGUGACACAG (SEQ ID NO: 416) | 19 |
| USH2A-297 | − | GGCCUGUGACUGUGACACAG (SEQ ID NO: 417) | 20 |
| USH2A-284 | − | GGUGUGAUCAUUGCAAUU (SEQ ID NO: 418) | 18 |
| USH2A-448 | − | GACACCUGCAGAGAAAACUUUU (SEQ ID NO: 419) | 22 |
| USH2A-445 | + | GCAUUACAGACAGUCCCAGGG (SEQ ID NO: 420) | 21 |
| USH2A-427 | − | GCUUAGGUGUGAUCAUUGCAAUU (SEQ ID NO: 421) | 23 |
| USH2A-430 | + | GCUUCUUUUUUGCACUACACUGCC (SEQ ID NO: 422) | 24 |
| USH2A-426 | − | GGCUUAGGUGUGAUCAUUGCAAUU (SEQ ID NO: 423) | 24 |
| USH2A-438 | − | GUAAGGCCUGUGACUGUGACACAG (SEQ ID NO: 424) | 24 |
| USH2A-446 | − | GUGACACCUGCAGAGAAAACUUUU (SEQ ID NO: 425) | 24 |

Table 5B provides targeting domains for the 2299delG site in the USH2A selected according to the second tier parameters. The targeting domains are within 200 bases of the 2299deG site, have good orthogonality and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5B

| gRNA Name | DNA Strand | Targeting Domain | Target Site Length |
|---|---|---|---|
| USH2A-295 | − | ACCUGCAGAGAAAACUUUU (SEQ ID NO: 590) | 19 |
| USH2A-288 | + | ACUGCCCAGAGUGAGGAUUG (SEQ ID NO: 591) | 20 |
| USH2A-283 | − | AGGUGUGAUCAUUGCAAUU (SEQ ID NO: 592) | 19 |
| USH2A-280 | + | AUUACAGACAGUCCCAGGG (SEQ ID NO: 593) | 19 |
| USH2A-294 | − | CACCUGCAGAGAAAACUUUU (SEQ ID NO: 594) | 20 |
| USH2A-293 | + | CACUACACUGCCCAGAGU (SEQ ID NO: 595) | 18 |
| USH2A-279 | + | CAUUACAGACAGUCCCAGGG (SEQ ID NO: 471) | 20 |
| USH2A-296 | − | CCUGCAGAGAAAACUUUU (SEQ ID NO: 597) | 18 |
| USH2A-299 | − | CCUGUGACUGUGACACAG (SEQ ID NO: 598) | 18 |
| USH2A-277 | − | CUCCGAAGCUUUAAUGAUG (SEQ ID NO: 599) | 19 |
| USH2A-289 | + | CUGCCCAGAGUGAGGAUUG (SEQ ID NO: 600) | 19 |
| USH2A-285 | + | CUUUUUUGCACUACACUGCC (SEQ ID NO: 601) | 20 |
| USH2A-282 | − | UAGGUGUGAUCAUUGCAAUU (SEQ ID NO: 602) | 20 |
| USH2A-278 | − | UCCGAAGCUUUAAUGAUG (SEQ ID NO: 603) | 18 |
| USH2A-276 | − | UCUCCGAAGCUUUAAUGAUG (SEQ ID NO: 604) | 20 |
| USH2A-291 | + | UGCACUACACUGCCCAGAGU (SEQ ID NO: 605) | 20 |
| USH2A-290 | + | UGCCCAGAGUGAGGAUUG (SEQ ID NO: 606) | 18 |
| USH2A-281 | + | UUACAGACAGUCCCAGGG (SEQ ID NO: 607) | 18 |
| USH2A-287 | + | UUUUUGCACUACACUGCC (SEQ ID NO: 608) | 18 |
| USH2A-286 | + | UUUUUUGCACUACACUGCC (SEQ ID NO: 609) | 19 |
| USH2A-440 | − | AAGGCCUGUGACUGUGACACAG (SEQ ID NO: 610) | 22 |
| USH2A-450 | − | AAUUUCUCCGAAGCUUUAAUGAUG (SEQ ID NO: 611) | 24 |
| USH2A-449 | − | ACACCUGCAGAGAAAACUUUU (SEQ ID NO: 612) | 21 |
| USH2A-456 | + | ACACUGCCCAGAGUGAGGAUUG (SEQ ID NO: 613) | 22 |
| USH2A-444 | + | AGCAUUACAGACAGUCCCAGGG (SEQ ID NO: 614) | 22 |
| USH2A-441 | − | AGGCCUGUGACUGUGACACAG (SEQ ID NO: 615) | 21 |
| USH2A-451 | − | AUUUCUCCGAAGCUUUAAUGAUG (SEQ ID NO: 616) | 23 |
| USH2A-457 | + | CACUGCCCAGAGUGAGGAUUG (SEQ ID NO: 617) | 21 |
| USH2A-454 | + | CUACACUGCCCAGAGUGAGGAUUG (SEQ ID NO: 618) | 24 |
| USH2A-428 | − | CUUAGGUGUGAUCAUUGCAAUU (SEQ ID NO: 619) | 22 |
| USH2A-431 | + | CUUCUUUUUUGCACUACACUGCC (SEQ ID NO: 620) | 23 |
| USH2A-439 | − | UAAGGCCUGUGACUGUGACACAG (SEQ ID NO: 621) | 23 |
| USH2A-455 | + | UACACUGCCCAGAGUGAGGAUUG (SEQ ID NO: 622) | 23 |
| USH2A-443 | + | UAGCAUUACAGACAGUCCCAGGG (SEQ ID NO: 623) | 23 |
| USH2A-433 | + | UCUUUUUUGCACUACACUGCC (SEQ ID NO: 624) | 21 |
| USH2A-447 | − | UGACACCUGCAGAGAAAACUUUU (SEQ ID NO: 625) | 23 |
| USH2A-442 | + | UUAGCAUUACAGACAGUCCCAGGG (SEQ ID NO: 626) | 24 |
| USH2A-429 | − | UUAGGUGUGAUCAUUGCAAUU (SEQ ID NO: 627) | 21 |
| USH2A-453 | − | UUCUCCGAAGCUUUAAUGAUG (SEQ ID NO: 628) | 21 |
| USH2A-432 | + | UUCUUUUUUGCACUACACUGCC (SEQ ID NO: 629) | 22 |
| USH2A-437 | + | UUGCACUACACUGCCCAGAGU (SEQ ID NO: 630) | 21 |
| USH2A-452 | − | UUUCUCCGAAGCUUUAAUGAUG (SEQ ID NO: 631) | 22 |
| USH2A-436 | + | UUUGCACUACACUGCCCAGAGU (SEQ ID NO: 632) | 22 |
| USH2A-435 | + | UUUUGCACUACACUGCCCAGAGU (SEQ ID NO: 633) | 23 |
| USH2A-434 | + | UUUUUGCACUACACUGCCCAGAGU (SEQ ID NO: 634) | 24 |

Table 5C provides targeting domains for the 2299delG site in the USH2A selected according to the third tier parameters. The targeting domains are within 200 bases of the 2299deG site, start with 5' G and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5C

| gRNA Name | DNA Strand | Targeting Domain | Target Site Length |
|---|---|---|---|
| USH2A-461 | + | GAUAAAAUAUAUUUAAAAGGU (SEQ ID NO: 635) | 21 |

Table 5D provides targeting domains for the 2299delG site in the USH2A selected according to the fourth tier parameters. The targeting domains are within 200 bases of the 2299deG site and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5D

4th Tier

| gRNA Name | DNA Strand | Targeting Domain | Target Site Length |
|---|---|---|---|
| USH2A-300 | + | AUAAAAUAUAUUUAAAAGGU (SEQ ID NO: 636) | 20 |
| USH2A-301 | + | UAAAAUAUAUUUAAAAGGU (SEQ ID NO: 637) | 19 |
| USH2A-302 | + | AAAAUAUAUUUAAAAGGU (SEQ ID NO: 638) | 18 |
| USH2A-458 | + | AAAGAUAAAAUAUAUUUAAAAGGU (SEQ ID NO: 639) | 24 |
| USH2A-459 | + | AAGAUAAAAUAUAUUUAAAAGGU (SEQ ID NO: 640) | 23 |
| USH2A-460 | + | AGAUAAAAUAUAUUUAAAAGGU (SEQ ID NO: 641) | 22 |

Table 5E provides targeting domains for the 2299delG site in the USH2A selected according to the fifth tier parameters. The targeting domains are within 200 bases of the 2299deG site and PAM is NNGRRV. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 5E

| gRNA Name | DNA Strand | Targeting Domain | Target Site Length |
|---|---|---|---|
| USH2A-303 | + | AUAUAUUUAAAAGGUGAGGA (SEQ ID NO: 570) | 20 |
| USH2A-304 | + | UAUAUUUAAAAGGUGAGGA (SEQ ID NO: 643) | 19 |
| USH2A-305 | + | AUAUUUAAAAGGUGAGGA (SEQ ID NO: 644) | 18 |
| USH2A-306 | + | UUUUCUCUGCAGGUGUCACA (SEQ ID NO: 645) | 20 |
| USH2A-307 | + | UUUCUCUGCAGGUGUCACA (SEQ ID NO: 646) | 19 |
| USH2A-308 | + | UUCUCUGCAGGUGUCACA (SEQ ID NO: 647) | 18 |
| USH2A-309 | + | UGCACUGUCUCCCUUCAACA (SEQ ID NO: 648) | 20 |
| USH2A-310 | + | GCACUGUCUCCCUUCAACA (SEQ ID NO: 649) | 19 |
| USH2A-311 | + | CACUGUCUCCCUUCAACA (SEQ ID NO: 650) | 18 |
| USH2A-312 | − | GUGCAUCUGCAAGCCCAAUG (SEQ ID NO: 651) | 20 |
| USH2A-313 | − | UGCAUCUGCAAGCCCAAUG (SEQ ID NO: 652) | 19 |
| USH2A-314 | − | GCAUCUGCAAGCCCAAUG (SEQ ID NO: 653) | 18 |
| USH2A-315 | − | CAAAUUCUGCAAUCCUCACU (SEQ ID NO: 654) | 20 |
| USH2A-316 | − | AAAUUCUGCAAUCCUCACU (SEQ ID NO: 655) | 19 |
| USH2A-317 | − | AAUUCUGCAAUCCUCACU (SEQ ID NO: 656) | 18 |
| USH2A-318 | − | UCUGCAAGCCCAAUGUUGAA (SEQ ID NO: 555) | 20 |
| USH2A-319 | − | CUGCAAGCCCAAUGUUGAA (SEQ ID NO: 658) | 19 |
| USH2A-320 | − | UGCAAGCCCAAUGUUGAA (SEQ ID NO: 659) | 18 |
| USH2A-321 | + | UUAGCAUUACAGACAGUCCC (SEQ ID NO: 477) | 20 |
| USH2A-322 | + | UAGCAUUACAGACAGUCCC (SEQ ID NO: 661) | 19 |
| USH2A-323 | + | AGCAUUACAGACAGUCCC (SEQ ID NO: 662) | 18 |
| USH2A-324 | − | GACAGUGCAAUAAAUGUUUG (SEQ ID NO: 663) | 20 |
| USH2A-325 | − | ACAGUGCAAUAAAUGUUUG (SEQ ID NO: 664) | 19 |
| USH2A-326 | − | CAGUGCAAUAAAUGUUUG (SEQ ID NO: 665) | 18 |
| USH2A-327 | − | UGACACAGCUGGAUCCCUCC (SEQ ID NO: 666) | 20 |
| USH2A-328 | − | GACACAGCUGGAUCCCUCC (SEQ ID NO: 667) | 19 |
| USH2A-329 | − | ACACAGCUGGAUCCCUCC (SEQ ID NO: 667) | 18 |
| USH2A-330 | + | CUUAGCAUUACAGACAGUCC (SEQ ID NO: 669) | 20 |
| USH2A-331 | + | UUAGCAUUACAGACAGUCC (SEQ ID NO: 670) | 19 |

TABLE 5E-continued

| gRNA Name | DNA Strand | Targeting Domain | Target Site Length |
|---|---|---|---|
| USH2A-332 | + | UAGCAUUACAGACAGUCC (SEQ ID NO: 671) | 18 |
| USH2A-333 | − | AAUUUGGAUUUAAAUUUCU (SEQ ID NO: 672) | 20 |
| USH2A-334 | − | AUUUGGAUUUAAAUUUCU (SEQ ID NO: 673) | 19 |
| USH2A-335 | − | UUUGGAUUUAAAUUUCU (SEQ ID NO: 674) | 18 |
| USH2A-336 | + | UUUGCACUACACUGCCCAGA (SEQ ID NO: 675) | 20 |
| USH2A-337 | + | UUGCACUACACUGCCCAGA (SEQ ID NO: 676) | 19 |
| USH2A-338 | + | UGCACUACACUGCCCAGA (SEQ ID NO: 677) | 18 |
| USH2A-339 | − | GGAGACAGUGCAAUAAAUGU (SEQ ID NO: 678) | 20 |
| USH2A-340 | − | GAGACAGUGCAAUAAAUGU (SEQ ID NO: 679) | 19 |
| USH2A-341 | − | AGACAGUGCAAUAAAUGU (SEQ ID NO: 680) | 18 |
| USH2A-342 | + | AAUGAUUUCAUUCAAGAUAG (SEQ ID NO: 681) | 20 |
| USH2A-343 | + | AUGAUUUCAUUCAAGAUAG (SEQ ID NO: 682) | 19 |
| USH2A-344 | + | UGAUUUCAUUCAAGAUAG (SEQ ID NO: 683) | 18 |
| USH2A-345 | − | ACAGUGCAAUAAAUGUUUGG (SEQ ID NO: 536) | 20 |
| USH2A-346 | − | CAGUGCAAUAAAUGUUUGG (SEQ ID NO: 685) | 19 |
| USH2A-347 | − | AGUGCAAUAAAUGUUUGG (SEQ ID NO: 686) | 18 |
| USH2A-348 | + | AGAUAAAAUAUAUUUAAAAG (SEQ ID NO: 687) | 20 |
| USH2A-349 | + | GAUAAAAUAUAUUUAAAAG (SEQ ID NO: 688) | 19 |
| USH2A-350 | + | AUAAAAUAUAUUUAAAAG (SEQ ID NO: 689) | 18 |
| USH2A-351 | + | UAUAUUUAAAGGUGAGGAU (SEQ ID NO: 575) | 20 |
| USH2A-352 | + | AUAUUUAAAGGUGAGGAU (SEQ ID NO: 691) | 19 |
| USH2A-353 | + | UAUUUAAAGGUGAGGAU (SEQ ID NO: 692) | 18 |
| USH2A-354 | − | CUGGGCAGUGUAGUGCAAAA (SEQ ID NO: 693) | 20 |
| USH2A-355 | − | UGGGCAGUGUAGUGCAAAA (SEQ ID NO: 694) | 19 |
| USH2A-356 | − | GGGCAGUGUAGUGCAAAA (SEQ ID NO: 695) | 18 |
| USH2A-357 | + | CCAACAUCAUUAAAGCUUCG (SEQ ID NO: 696) | 20 |
| USH2A-358 | + | CAACAUCAUUAAAGCUUCG (SEQ ID NO: 697) | 19 |
| USH2A-359 | + | AACAUCAUUAAAGCUUCG (SEQ ID NO: 698) | 18 |
| USH2A-360 | − | UUGUGUCUCGUCUAUCUUGA (SEQ ID NO: 699) | 20 |
| USH2A-361 | − | UGUGUCUCGUCUAUCUUGA (SEQ ID NO: 700) | 19 |
| USH2A-362 | − | GUGUCUCGUCUAUCUUGA (SEQ ID NO: 701) | 18 |
| USH2A-363 | + | UAGCAUUACAGACAGUCCCA (SEQ ID NO: 475) | 20 |
| USH2A-364 | + | AGCAUUACAGACAGUCCCA (SEQ ID NO: 703) | 19 |
| USH2A-365 | + | GCAUUACAGACAGUCCCA (SEQ ID NO: 704) | 18 |
| USH2A-366 | − | AUCUGCAAGCCCAAUGUUGA (SEQ ID NO: 543) | 20 |
| USH2A-367 | − | UCUGCAAGCCCAAUGUUGA (SEQ ID NO: 706) | 19 |
| USH2A-368 | − | CUGCAAGCCCAAUGUUGA (SEQ ID NO: 707) | 18 |
| USH2A-369 | − | UUUUAAAUAUAUUUUAUCUU (SEQ ID NO: 708) | 20 |
| USH2A-370 | − | UUUAAAUAUAUUUUAUCUU (SEQ ID NO: 709) | 19 |
| USH2A-371 | − | UUAAAUAUAUUUUAUCUU (SEQ ID NO: 710) | 18 |
| USH2A-372 | + | CAUCCAACAUCAUUAAAGCU (SEQ ID NO: 711) | 20 |
| USH2A-373 | + | AUCCAACAUCAUUAAAGCU (SEQ ID NO: 712) | 19 |
| USH2A-374 | + | UCCAACAUCAUUAAAGCU (SEQ ID NO: 713) | 18 |
| USH2A-375 | + | GCAUUACAGACAGUCCCAGG (SEQ ID NO: 714) | 20 |
| USH2A-376 | + | CAUUACAGACAGUCCCAGG (SEQ ID NO: 715) | 19 |
| USH2A-377 | + | AUUACAGACAGUCCCAGG (SEQ ID NO: 716) | 18 |
| USH2A-378 | + | CAGAAUUUGUUCACUGAGCC (SEQ ID NO: 717) | 20 |
| USH2A-379 | + | AGAAUUUGUUCACUGAGCC (SEQ ID NO: 718) | 19 |
| USH2A-380 | + | GAAUUUGUUCACUGAGCC (SEQ ID NO: 719) | 18 |
| USH2A-381 | − | ACUUCAGUGUGACACCUGCA (SEQ ID NO: 720) | 20 |

TABLE 5E-continued

| gRNA Name | DNA Strand | Targeting Domain | Target Site Length |
|---|---|---|---|
| USH2A-382 | − | CUUCAGUGUGACACCUGCA (SEQ ID NO: 721) | 19 |
| USH2A-383 | − | UUCAGUGUGACACCUGCA (SEQ ID NO: 722) | 18 |
| USH2A-384 | − | CAGUGCAAUAAAUGUUUGGA (SEQ ID NO: 546) | 20 |
| USH2A-385 | − | AGUGCAAUAAAUGUUUGGA (SEQ ID NO: 724) | 19 |
| USH2A-386 | − | GUGCAAUAAAUGUUUGGA (SEQ ID NO: 725) | 18 |
| USH2A-387 | − | GAGACAGUGCAAUAAAUGUU (SEQ ID NO: 408) | 20 |
| USH2A-388 | − | AGACAGUGCAAUAAAUGUU (SEQ ID NO: 727) | 19 |
| USH2A-389 | − | GACAGUGCAAUAAAUGUU (SEQ ID NO: 728) | 18 |
| USH2A-390 | − | AAGCUUUAAUGAUGUUGGAU (SEQ ID NO: 729) | 20 |
| USH2A-391 | − | AGCUUUAAUGAUGUUGGAU (SEQ ID NO: 730) | 19 |
| USH2A-392 | − | GCUUUAAUGAUGUUGGAU (SEQ ID NO: 731) | 18 |
| USH2A-393 | + | AAUAUAUUUAAAAGGUGAGG (SEQ ID NO: 732) | 20 |
| USH2A-394 | + | AUAUAUUUAAAAGGUGAGG (SEQ ID NO: 733) | 19 |
| USH2A-395 | + | UAUAUUUAAAAGGUGAGG (SEQ ID NO: 734) | 18 |
| USH2A-396 | − | GGACUUCAGUGUGACACCUG (SEQ ID NO: 735) | 20 |
| USH2A-397 | − | GACUUCAGUGUGACACCUG (SEQ ID NO: 736) | 19 |
| USH2A-398 | − | ACUUCAGUGUGACACCUG (SEQ ID NO: 737) | 18 |
| USH2A-399 | + | AUCCAACAUCAUUAAAGCUU (SEQ ID NO: 467) | 20 |
| USH2A-400 | + | UCCAACAUCAUUAAAGCUU (SEQ ID NO: 739) | 19 |
| USH2A-401 | + | CCAACAUCAUUAAAGCUU (SEQ ID NO: 740) | 18 |
| USH2A-402 | − | AGUGUAACCUCCAUGGCUCA (SEQ ID NO: 741) | 20 |
| USH2A-403 | − | GUGUAACCUCCAUGGCUCA (SEQ ID NO: 742) | 19 |
| USH2A-404 | − | UGUAACCUCCAUGGCUCA (SEQ ID NO: 743) | 18 |
| USH2A-405 | + | AGAAUUGUUCACUGAGCCA (SEQ ID NO: 466) | 20 |
| USH2A-406 | + | GAAUUGUUCACUGAGCCA (SEQ ID NO: 745) | 19 |
| USH2A-407 | + | AAUUUGUUCACUGAGCCA (SEQ ID NO: 746) | 18 |
| USH2A-408 | − | GUAGUGCAAAAAAGAAGCCA (SEQ ID NO: 747) | 20 |
| USH2A-409 | − | UAGUGCAAAAAAGAAGCCA (SEQ ID NO: 748) | 19 |
| USH2A-410 | − | AGUGCAAAAAAGAAGCCA (SEQ ID NO: 749) | 18 |
| USH2A-411 | − | CAUCUGCAAGCCCAAUGUUG (SEQ ID NO: 750) | 20 |
| USH2A-412 | − | AUCUGCAAGCCCAAUGUUG (SEQ ID NO: 751) | 19 |
| USH2A-413 | − | UCUGCAAGCCCAAUGUUG (SEQ ID NO: 752) | 18 |
| USH2A-414 | − | GACUGUCUGUAAUGCUAAGA (SEQ ID NO: 753) | 20 |
| USH2A-415 | − | ACUGUCUGUAAUGCUAAGA (SEQ ID NO: 754) | 19 |
| USH2A-416 | − | CUGUCUGUAAUGCUAAGA (SEQ ID NO: 755) | 18 |
| USH2A-417 | − | GACACAGCUGGAUCCCUCCC (SEQ ID NO: 407) | 20 |
| USH2A-418 | − | ACACAGCUGGAUCCCUCCC (SEQ ID NO: 757) | 19 |
| USH2A-419 | − | CACAGCUGGAUCCCUCCC (SEQ ID NO: 758) | 18 |
| USH2A-420 | + | AGGAUUGCAGAAUUUGUUCA (SEQ ID NO: 759) | 20 |
| USH2A-421 | + | GGAUUGCAGAAUUUGUUCA (SEQ ID NO: 760) | 19 |
| USH2A-422 | + | GAUUGCAGAAUUUGUUCA (SEQ ID NO: 761) | 18 |
| USH2A-423 | + | AGCCAUGGAGGUUACACUGG (SEQ ID NO: 762) | 20 |
| USH2A-424 | + | GCCAUGGAGGUUACACUGG (SEQ ID NO: 763) | 19 |
| USH2A-425 | + | CCAUGGAGGUUACACUGG (SEQ ID NO: 764) | 18 |
| USH2A-462 | + | CUCACAUCCAACAUCAUUAAAGCU (SEQ ID NO: 765) | 24 |
| USH2A-463 | + | UCACAUCCAACAUCAUUAAAGCU (SEQ ID NO: 766) | 23 |
| USH2A-464 | + | CACAUCCAACAUCAUUAAAGCU (SEQ ID NO: 767) | 22 |
| USH2A-465 | + | ACAUCCAACAUCAUUAAAGCU (SEQ ID NO: 768) | 21 |
| USH2A-466 | + | AUUGCAGAAUUUGUUCACUGAGCC (SEQ ID NO: 769) | 24 |
| USH2A-467 | + | UUGCAGAAUUUGUUCACUGAGCC (SEQ ID NO: 770) | 23 |

TABLE 5E-continued

| gRNA Name | DNA Strand | Targeting Domain | Target Site Length |
|---|---|---|---|
| USH2A-468 | + | UGCAGAAUUUGUUCACUGAGCC (SEQ ID NO: 771) | 22 |
| USH2A-469 | + | GCAGAAUUUGUUCACUGAGCC (SEQ ID NO: 772) | 21 |
| USH2A-470 | − | CUGGGACUGUCUGUAAUGCUAAGA (SEQ ID NO: 773) | 24 |
| USH2A-471 | − | UGGGACUGUCUGUAAUGCUAAGA (SEQ ID NO: 774) | 23 |
| USH2A-472 | − | GGGACUGUCUGUAAUGCUAAGA (SEQ ID NO: 775) | 22 |
| USH2A-473 | − | GGACUGUCUGUAAUGCUAAGA (SEQ ID NO: 776) | 21 |
| USH2A-474 | + | UUGCAGAAUUUGUUCACUGAGCCA (SEQ ID NO: 777) | 24 |
| USH2A-475 | + | UGCAGAAUUUGUUCACUGAGCCA (SEQ ID NO: 778) | 23 |
| USH2A-476 | + | GCAGAAUUUGUUCACUGAGCCA (SEQ ID NO: 779) | 22 |
| USH2A-477 | + | CAGAAUUUGUUCACUGAGCCA (SEQ ID NO: 780) | 21 |
| USH2A-478 | − | GAAGGGAGACAGUGCAAUAAAUGU (SEQ ID NO: 781) | 24 |
| USH2A-479 | − | AAGGGAGACAGUGCAAUAAAUGU (SEQ ID NO: 782) | 23 |
| USH2A-480 | − | AGGGAGACAGUGCAAUAAAUGU (SEQ ID NO: 783) | 22 |
| USH2A-481 | − | GGGAGACAGUGCAAUAAAUGU (SEQ ID NO: 784) | 21 |
| USH2A-482 | + | AAAGUUUCUCUGCAGGUGUCACA (SEQ ID NO: 785) | 24 |
| USH2A-483 | + | AAGUUUCUCUGCAGGUGUCACA (SEQ ID NO: 786) | 23 |
| USH2A-484 | + | AGUUUCUCUGCAGGUGUCACA (SEQ ID NO: 787) | 22 |
| USH2A-485 | + | GUUUCUCUGCAGGUGUCACA (SEQ ID NO: 788) | 21 |
| USH2A-486 | + | CUUAGCAUUACAGACAGUCCCAGG (SEQ ID NO: 789) | 24 |
| USH2A-487 | + | UUAGCAUUACAGACAGUCCCAGG (SEQ ID NO: 790) | 23 |
| USH2A-488 | + | UAGCAUUACAGACAGUCCCAGG (SEQ ID NO: 791) | 22 |
| USH2A-489 | + | AGCAUUACAGACAGUCCCAGG (SEQ ID NO: 792) | 21 |
| USH2A-490 | + | CUAAAGAUAAAAUAUAUUUAAAAG (SEQ ID NO: 793) | 24 |
| USH2A-491 | + | UAAAGAUAAAAUAUAUUUAAAAG (SEQ ID NO: 794) | 23 |
| USH2A-492 | + | AAAGAUAAAAUAUAUUUAAAAG (SEQ ID NO: 795) | 22 |
| USH2A-493 | + | AAGAUAAAAUAUAUUUAAAAG (SEQ ID NO: 796) | 21 |
| USH2A-494 | − | UGCAUCUGCAAGCCCAAUGUUGAA (SEQ ID NO: 797) | 24 |
| USH2A-495 | − | GCAUCUGCAAGCCCAAUGUUGAA (SEQ ID NO: 798) | 23 |
| USH2A-496 | − | CAUCUGCAAGCCCAAUGUUGAA (SEQ ID NO: 799) | 22 |
| USH2A-497 | − | AUCUGCAAGCCCAAUGUUGAA (SEQ ID NO: 800) | 21 |
| USH2A-498 | + | ACUGAGCCAUGGAGGUUACACUGG (SEQ ID NO: 801) | 24 |
| USH2A-499 | + | CUGAGCCAUGGAGGUUACACUGG (SEQ ID NO: 802) | 23 |
| USH2A-500 | + | UGAGCCAUGGAGGUUACACUGG (SEQ ID NO: 803) | 22 |
| USH2A-501 | + | GAGCCAUGGAGGUUACACUGG (SEQ ID NO: 804) | 21 |
| USH2A-502 | − | AAGGACUUCAGUGUGACACCUGCA (SEQ ID NO: 805) | 24 |
| USH2A-503 | − | AGGACUUCAGUGUGACACCUGCA (SEQ ID NO: 806) | 23 |
| USH2A-504 | − | GGACUUCAGUGUGACACCUGCA (SEQ ID NO: 807) | 22 |
| USH2A-505 | − | GACUUCAGUGUGACACCUGCA (SEQ ID NO: 808) | 21 |
| USH2A-506 | + | AGUGAGGAUUGCAGAAUUUGUUCA (SEQ ID NO: 809) | 24 |
| USH2A-507 | + | GUGAGGAUUGCAGAAUUUGUUCA (SEQ ID NO: 810) | 23 |
| USH2A-508 | + | UGAGGAUUGCAGAAUUUGUUCA (SEQ ID NO: 811) | 22 |
| USH2A-509 | + | GAGGAUUGCAGAAUUUGUUCA (SEQ ID NO: 812) | 21 |
| USH2A-510 | + | UAAAAUAUAUUUAAAAGGUGAGGA (SEQ ID NO: 813) | 24 |
| USH2A-511 | + | AAAAUAUAUUUAAAAGGUGAGGA (SEQ ID NO: 814) | 23 |
| USH2A-512 | + | AAAUAUAUUUAAAAGGUGAGGA (SEQ ID NO: 815) | 22 |
| USH2A-513 | + | AAUAUAUUUAAAAGGUGAGGA (SEQ ID NO: 816) | 21 |
| USH2A-514 | − | CUGUGACACAGCUGGAUCCCUCCC (SEQ ID NO: 817) | 24 |
| USH2A-515 | − | UGUGACACAGCUGGAUCCCUCCC (SEQ ID NO: 818) | 23 |
| USH2A-516 | − | GUGACACAGCUGGAUCCCUCCC (SEQ ID NO: 819) | 22 |
| USH2A-517 | − | UGACACAGCUGGAUCCCUCCC (SEQ ID NO: 820) | 21 |

TABLE 5E-continued

| gRNA Name | DNA Strand | Targeting Domain | Target Site Length |
|---|---|---|---|
| USH2A-518 | + | CUGUCUUAGCAUUACAGACAGUCC (SEQ ID NO: 821) | 24 |
| USH2A-519 | + | UGUCUUAGCAUUACAGACAGUCC (SEQ ID NO: 822) | 23 |
| USH2A-520 | + | GUCUUAGCAUUACAGACAGUCC (SEQ ID NO: 823) | 22 |
| USH2A-521 | + | UCUUAGCAUUACAGACAGUCC (SEQ ID NO: 824) | 21 |
| USH2A-522 | − | UGAACAAAUUCUGCAAUCCUCACU (SEQ ID NO: 825) | 24 |
| USH2A-523 | − | GAACAAAUUCUGCAAUCCUCACU (SEQ ID NO: 826) | 23 |
| USH2A-524 | − | AACAAAUUCUGCAAUCCUCACU (SEQ ID NO: 827) | 22 |
| USH2A-525 | − | ACAAAUUCUGCAAUCCUCACU (SEQ ID NO: 828) | 21 |
| USH2A-526 | − | CAAAGGACUUCAGUGUGACACCUG (SEQ ID NO: 829) | 24 |
| USH2A-527 | − | AAAGGACUUCAGUGUGACACCUG (SEQ ID NO: 830) | 23 |
| USH2A-528 | − | AAGGACUUCAGUGUGACACCUG (SEQ ID NO: 831) | 22 |
| USH2A-529 | − | AGGACUUCAGUGUGACACCUG (SEQ ID NO: 832) | 21 |
| USH2A-530 | − | CACCUUUUAAAUAUAUUUUAUCUU (SEQ ID NO: 833) | 24 |
| USH2A-531 | − | ACCUUUUAAAUAUAUUUUAUCUU (SEQ ID NO: 834) | 23 |
| USH2A-532 | − | CCUUUUAAAUAUAUUUUAUCUU (SEQ ID NO: 835) | 22 |
| USH2A-533 | − | CUUUUAAAUAUAUUUUAUCUU (SEQ ID NO: 836) | 21 |
| USH2A-534 | − | GUGCAUCUGCAAGCCCAAUGUUGA (SEQ ID NO: 837) | 24 |
| USH2A-535 | − | UGCAUCUGCAAGCCCAAUGUUGA (SEQ ID NO: 838) | 23 |
| USH2A-536 | − | GCAUCUGCAAGCCCAAUGUUGA (SEQ ID NO: 839) | 22 |
| USH2A-537 | − | CAUCUGCAAGCCCAAUGUUGA (SEQ ID NO: 840) | 21 |
| USH2A-538 | + | GUCUUAGCAUUACAGACAGUCCCA (SEQ ID NO: 841) | 24 |
| USH2A-539 | + | UCUUAGCAUUACAGACAGUCCCA (SEQ ID NO: 842) | 23 |
| USH2A-540 | + | CUUAGCAUUACAGACAGUCCCA (SEQ ID NO: 843) | 22 |
| USH2A-541 | + | UUAGCAUUACAGACAGUCCCA (SEQ ID NO: 844) | 21 |
| USH2A-542 | − | AGUGCAUCUGCAAGCCCAAUGUUG (SEQ ID NO: 845) | 24 |
| USH2A-543 | − | GUGCAUCUGCAAGCCCAAUGUUG (SEQ ID NO: 846) | 23 |
| USH2A-544 | − | UGCAUCUGCAAGCCCAAUGUUG (SEQ ID NO: 847) | 22 |
| USH2A-545 | − | GCAUCUGCAAGCCCAAUGUUG (SEQ ID NO: 848) | 21 |
| USH2A-546 | − | CACUCUGGGCAGUGUAGUGCAAAA (SEQ ID NO: 849) | 24 |
| USH2A-547 | − | ACUCUGGGCAGUGUAGUGCAAAA (SEQ ID NO: 850) | 23 |
| USH2A-548 | − | CUCUGGGCAGUGUAGUGCAAAA (SEQ ID NO: 851) | 22 |
| USH2A-549 | − | UCUGGGCAGUGUAGUGCAAAA (SEQ ID NO: 852) | 21 |
| USH2A-550 | + | UGUCUUAGCAUUACAGACAGUCCC (SEQ ID NO: 853) | 24 |
| USH2A-551 | + | GUCUUAGCAUUACAGACAGUCCC (SEQ ID NO: 854) | 23 |
| USH2A-552 | + | UCUUAGCAUUACAGACAGUCCC (SEQ ID NO: 855) | 22 |
| USH2A-553 | + | CUUAGCAUUACAGACAGUCCC (SEQ ID NO: 856) | 21 |
| USH2A-554 | + | CUUUUUUGCACUACACUGCCCAGA (SEQ ID NO: 857) | 24 |
| USH2A-555 | + | UUUUUUGCACUACACUGCCCAGA (SEQ ID NO: 858) | 23 |
| USH2A-556 | + | UUUUUGCACUACACUGCCCAGA (SEQ ID NO: 859) | 22 |
| USH2A-557 | + | UUUUGCACUACACUGCCCAGA (SEQ ID NO: 860) | 21 |
| USH2A-558 | − | CAGUGUAGUGCAAAAAAGAAGCCA (SEQ ID NO: 861) | 24 |
| USH2A-559 | − | AGUGUAGUGCAAAAAAGAAGCCA (SEQ ID NO: 862) | 23 |
| USH2A-560 | − | GUGUAGUGCAAAAAAGAAGCCA (SEQ ID NO: 863) | 22 |
| USH2A-561 | − | UGUAGUGCAAAAAAGAAGCCA (SEQ ID NO: 864) | 21 |
| USH2A-562 | + | AAAAUAUAUUUAAAAGGUGAGGAU (SEQ ID NO: 865) | 24 |
| USH2A-563 | + | AAAUAUAUUUAAAAGGUGAGGAU (SEQ ID NO: 866) | 23 |
| USH2A-564 | + | AAUAUAUUUAAAAGGUGAGGAU (SEQ ID NO: 867) | 22 |
| USH2A-565 | + | AUAUAUUUAAAAGGUGAGGAU (SEQ ID NO: 868) | 21 |
| USH2A-566 | − | ACUGUGACACAGCUGGAUCCCUCC (SEQ ID NO: 869) | 24 |
| USH2A-567 | − | CUGUGACACAGCUGGAUCCCUCC (SEQ ID NO: 870) | 23 |

TABLE 5E-continued

| gRNA Name | DNA Strand | Targeting Domain | Target Site Length |
|---|---|---|---|
| USH2A-568 | − | UGUGACACAGCUGGAUCCCUCC (SEQ ID NO: 871) | 22 |
| USH2A-569 | − | GUGACACAGCUGGAUCCCUCC (SEQ ID NO: 872) | 21 |
| USH2A-570 | − | UGCCAGUGUAACCUCCAUGGCUCA (SEQ ID NO: 873) | 24 |
| USH2A-571 | − | GCCAGUGUAACCUCCAUGGCUCA (SEQ ID NO: 874) | 23 |
| USH2A-572 | − | CCAGUGUAACCUCCAUGGCUCA (SEQ ID NO: 875) | 22 |
| USH2A-573 | − | CAGUGUAACCUCCAUGGCUCA (SEQ ID NO: 876) | 21 |
| USH2A-574 | − | UUGCAAUUUUGGAUUUAAAUUUCU (SEQ ID NO: 877) | 24 |
| USH2A-575 | − | UGCAAUUUUGGAUUUAAAUUUCU (SEQ ID NO: 878) | 23 |
| USH2A-576 | − | GCAAUUUUGGAUUUAAAUUUCU (SEQ ID NO: 879) | 22 |
| USH2A-577 | − | CAAUUUUGGAUUUAAAUUUCU (SEQ ID NO: 880) | 21 |
| USH2A-578 | − | GAGACAGUGCAAUAAAUGUUUGGA (SEQ ID NO: 881) | 24 |
| USH2A-579 | − | AGACAGUGCAAUAAAUGUUUGGA (SEQ ID NO: 882) | 23 |
| USH2A-580 | − | GACAGUGCAAUAAAUGUUUGGA (SEQ ID NO: 883) | 22 |
| USH2A-581 | − | ACAGUGCAAUAAAUGUUUGGA (SEQ ID NO: 884) | 21 |
| USH2A-582 | + | GGAAAAUGAUUUCAUUCAAGAUAG (SEQ ID NO: 885) | 24 |
| USH2A-583 | + | GAAAAUGAUUUCAUUCAAGAUAG (SEQ ID NO: 886) | 23 |
| USH2A-584 | + | AAAAUGAUUUCAUUCAAGAUAG (SEQ ID NO: 887) | 22 |
| USH2A-585 | + | AAAUGAUUUCAUUCAAGAUAG (SEQ ID NO: 888) | 21 |
| USH2A-586 | + | AUAAAAUAUUUAAAAGGUGAGG (SEQ ID NO: 889) | 24 |
| USH2A-587 | + | UAAAAUAUUUAAAAGGUGAGG (SEQ ID NO: 890) | 23 |
| USH2A-588 | + | AAAAUAUUUAAAAGGUGAGG (SEQ ID NO: 891) | 22 |
| USH2A-589 | + | AAAUAUUUAAAAGGUGAGG (SEQ ID NO: 892) | 21 |
| USH2A-590 | − | AAGGGAGACAGUGCAAUAAAUGUU (SEQ ID NO: 893) | 24 |
| USH2A-591 | − | AGGGAGACAGUGCAAUAAAUGUU (SEQ ID NO: 894) | 23 |
| USH2A-592 | − | GGGAGACAGUGCAAUAAAUGUU (SEQ ID NO: 895) | 22 |
| USH2A-593 | − | GGAGACAGUGCAAUAAAUGUU (SEQ ID NO: 896) | 21 |
| USH2A-594 | + | UCACAUCCAACAUCAUUAAAGCUU (SEQ ID NO: 897) | 24 |
| USH2A-595 | + | CACAUCCAACAUCAUUAAAGCUU (SEQ ID NO: 898) | 23 |
| USH2A-596 | + | ACAUCCAACAUCAUUAAAGCUU (SEQ ID NO: 899) | 22 |
| USH2A-597 | + | CAUCCAACAUCAUUAAAGCUU (SEQ ID NO: 900) | 21 |
| USH2A-598 | − | GGAGACAGUGCAAUAAAUGUUUGG (SEQ ID NO: 901) | 24 |
| USH2A-599 | − | GAGACAGUGCAAUAAAUGUUUGG (SEQ ID NO: 902) | 23 |
| USH2A-600 | − | AGACAGUGCAAUAAAUGUUUGG (SEQ ID NO: 903) | 22 |
| USH2A-601 | − | GACAGUGCAAUAAAUGUUUGG (SEQ ID NO: 904) | 21 |
| USH2A-602 | + | UUAUUGCACUGUCUCCCUUCAACA (SEQ ID NO: 905) | 24 |
| USH2A-603 | + | UAUUGCACUGUCUCCCUUCAACA (SEQ ID NO: 906) | 23 |
| USH2A-604 | + | AUUGCACUGUCUCCCUUCAACA (SEQ ID NO: 907) | 22 |
| USH2A-605 | + | UUGCACUGUCUCCCUUCAACA (SEQ ID NO: 908) | 21 |
| USH2A-606 | + | ACAUCCAACAUCAUUAAAGCUUCG (SEQ ID NO: 909) | 24 |
| USH2A-607 | + | CAUCCAACAUCAUUAAAGCUUCG (SEQ ID NO: 910) | 23 |
| USH2A-608 | + | AUCCAACAUCAUUAAAGCUUCG (SEQ ID NO: 911) | 22 |
| USH2A-609 | + | UCCAACAUCAUUAAAGCUUCG (SEQ ID NO: 912) | 21 |
| USH2A-610 | − | UCCGAAGCUUUAAUGAUGUUGGAU (SEQ ID NO: 913) | 24 |
| USH2A-611 | − | CCGAAGCUUUAAUGAUGUUGGAU (SEQ ID NO: 914) | 23 |
| USH2A-612 | − | CGAAGCUUUAAUGAUGUUGGAU (SEQ ID NO: 915) | 22 |
| USH2A-613 | − | GAAGCUUUAAUGAUGUUGGAU (SEQ ID NO: 916) | 21 |
| USH2A-614 | − | GGCAGUGCAUCUGCAAGCCCAAUG (SEQ ID NO: 917) | 24 |
| USH2A-615 | − | GCAGUGCAUCUGCAAGCCCAAUG (SEQ ID NO: 918) | 23 |
| USH2A-616 | − | CAGUGCAUCUGCAAGCCCAAUG (SEQ ID NO: 919) | 22 |
| USH2A-617 | − | AGUGCAUCUGCAAGCCCAAUG (SEQ ID NO: 920) | 21 |

TABLE 5E-continued

| gRNA Name | DNA Strand | Targeting Domain | Target Site Length |
|---|---|---|---|
| USH2A-618 | − | GGGAGACAGUGCAAUAAAUGUUUG (SEQ ID NO: 921) | 24 |
| USH2A-619 | − | GGAGACAGUGCAAUAAAUGUUUG (SEQ ID NO: 922) | 23 |
| USH2A-620 | − | GAGACAGUGCAAUAAAUGUUUG (SEQ ID NO: 923) | 22 |
| USH2A-621 | − | AGACAGUGCAAUAAAUGUUUG (SEQ ID NO: 924) | 21 |

Table 5F provides targeting domains for the 2299delG site in the USH2A gene that can be used for dual targeting. Any of the targeting domains in the table can be used with a *S. aureus* Cas9 (nickase) molecule to generate a single stranded break.

Exemplary nickase pairs including selecting a targeting domain from Group A and a second targeting domain from Group B. It is contemplated herein that in an embodiment a targeting domain of Group A can be combined with any of the targeting domains of Group B. For example, USH2A-288 can be combined with USH2A-448.

TABLE 5F

| Group A | Group B |
|---|---|
| USH2A-288 (SEQ ID NO: 591) | USH2A-448 (SEQ ID NO: 419) |

Table 6A provides targeting domains for the 2299delG site in the USH2A selected according to the first tier parameters. The targeting domains are within 200 bases of the 2299deG site, have good orthogonality, and start with G. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 6A

| gRNA Name | DNA Strand | Targeting Domain | Target Site Length |
|---|---|---|---|
| USH2A-264 | + | GUGUCACACUGAAGUCC (SEQ ID NO: 426) | 17 |
| USH2A-261 | − | GGUGUGAUCAUUGCAAU (SEQ ID NO: 427) | 17 |
| USH2A-270 | + | GGGCUCACAUCCAACAUCAU (SEQ ID NO: 428) | 20 |

Table 6B provides targeting domains for the 2299delG site in the USH2A selected according to the second tier parameters. The targeting domains are within 200 bases of the 2299deG site and have good orthogonality. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 6B

| gRNA Name | DNA Strand | Targeting Domain | Target Site Length |
|---|---|---|---|
| USH2A-263 | + | CACUACACUGCCCAGAG (SEQ ID NO: 928) | 17 |
| USH2A-266 | + | AAAAGGUGAGGAUGGGA (SEQ ID NO: 929) | 17 |
| USH2A-260 | + | CUCACAUCCAACAUCAU (SEQ ID NO: 930) | 17 |
| USH2A-262 | + | ACUGUCUCCCUUCAACA (SEQ ID NO: 931) | 17 |
| USH2A-273 | + | CAGGUGUCACACUGAAGUCC (SEQ ID NO: 932) | 20 |
| USH2A-268 | − | UUAGGUGUGAUCAUUGCAAU (SEQ ID NO: 933) | 20 |
| USH2A-269 | + | UUGCACUACACUGCCCAGAG (SEQ ID NO: 934) | 20 |
| USH2A-271 | + | UGCACUGUCUCCCUUCAACA (SEQ ID NO: 648) | 20 |
| USH2A-274 | + | UUUAAAAGGUGAGGAUGGGA (SEQ ID NO: 936) | 20 |

Table 6C provides targeting domains for the 2299delG site in the USH2A selected according to the fourth tier parameters. The targeting domains are within 200 bases of the 2299deG site. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 6C

| gRNA Name | DNA Strand | Targeting Domain | Target Site Length |
|---|---|---|---|
| USH2A-267 | − | UAAAUAUAUUUUAUCUU (SEQ ID NO: 937) | 17 |
| USH2A-265 | − | UUGGAUUUAAAUUUCUC (SEQ ID NO: 938) | 17 |
| USH2A-272 | − | UUUUAAAUAUAUUUUAUCUU (SEQ ID NO: 708) | 20 |
| USH2A-275 | − | AUUUUGGAUUUAAAUUUCUC (SEQ ID NO: 940) | 20 |

Table 6D provides targeting domains for the 2299delG site in the USH2A gene that can be used for dual targeting. Any of the targeting domains in the table can be used with a *N. meningitidis* Cas9 (nickase) molecule to generate a single stranded break.

Exemplary nickase pairs including selecting a targeting domain from Group A and a second targeting domain from Group B. It is contemplated herein that in an embodiment a targeting domain of Group A can be combined with any of the targeting domains of Group B. For example, USH2A-266 can be combined with USH2A-261 or USH2A-268 can be combined with USH2A-261.

TABLE 6D

| Group A | Group B |
| --- | --- |
| USH2A-266 (SEQ ID NO: 929) | USH2A-261 (SEQ ID NO: 427) |
| USH2A-268 (SEQ ID NO: 933) | |

III. Cas9 Molecules

Cas9 molecules of a variety of species can be used in the methods and compostions described herein. While the *S. pyogenes, S. aureus*, and *S. thermophilus* Cas9 molecules are the subject of much of the disclosure herein, Cas9 molecules of, derived from, or based on the Cas9 proteins of other species listed herein can be used as well. In other words, while much of the description herein uses *S. pyogenes* and *S. thermophilus* Cas9 molecules Cas9 molecules from the other species can replace them. Such species include: *Acidovorax avenae, Actinobacillus pleuropneumonias, Actinobacillus succinogenes, Actinobacillus suis, Actinomyces* sp., *Cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria meningitides, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus aureus, Staphylococcus lugdunensis, Streptococcus* sp., *Subdoligranulum* sp., *Tistrella mobilis, Treponema* sp., or *Verminephrobacter eiseniae.*

A Cas9 molecule, or Cas9 polypeptide, as that term is used herein, refers to a molecule or polypeptide that can interact with a guide RNA (gRNA) molecule and, in concert with the gRNA molecule, home or localizes to a site which comprises a target domain and PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table 7.

Cas9 Domains

Crystal structures have been determined for two different naturally occurring bacterial Cas9 molecules (Jinek et al., Science, 343(6176):1247997, 2014) and for *S. pyogenes* Cas9 with a guide RNA (e.g., a synthetic fusion of crRNA and tracrRNA) (Nishimasu et al., Cell, 156:935-949, 2014; and Anders et al., Nature, 2014, doi: 10.1038/nature13579).

A naturally occurring Cas9 molecule comprises two lobes: a recognition (REC) lobe and a nuclease (NUC) lobe; each of which further comprises domains described herein.

Figure 9A:
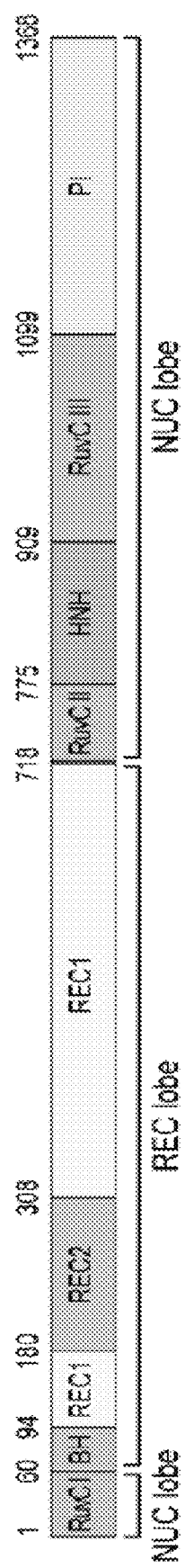
FIGS. 9A and 9B are schematic representations of the domain organization of *S. pyogenes* Cas 9.
Figure 9B:
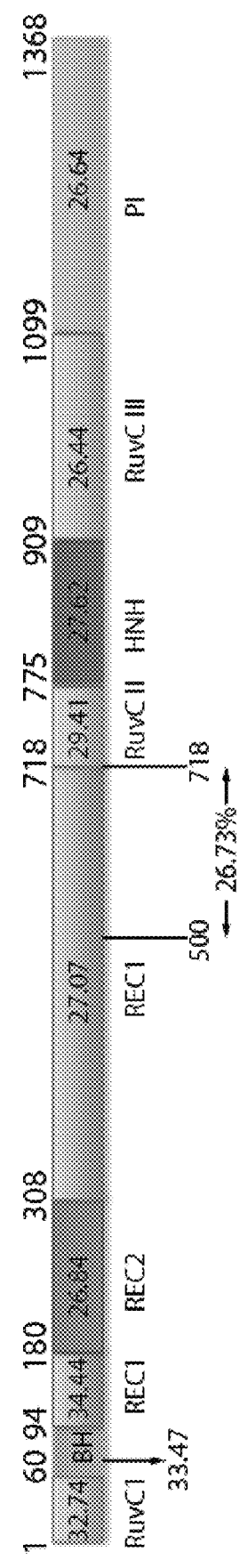

FIGS. 9A-9B provide a schematic of the organization of important Cas9 domains in the primary structure. The domain nomenclature and the numbering of the amino acid residues encompassed by each domain used throughout this disclosure is as described in Nishimasu et al. The numbering of the amino acid residues is with reference to Cas9 from *S. pyogenes.*

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain (also referred to herein as RuvC-like domain), the HNH domain (also referred to herein as HNH-like domain), and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

A RuvC-Like Domain and an HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

D-X1-G-X2-X3-X4-X5-G-X6-X7-X8-X9     (SEQ ID NO: 8), wherein,

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X4 is selected from S, Y, N and F (e.g., S);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent, designated by Δ (e.g., selected from T, V, I, L, Δ, F, S, A, Y, M and R, or, e.g., selected from T, V, I, L and Δ).

In an embodiment, the N-terminal RuvC-like domain differs from a sequence of SEQ ID NO:8, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

D-X1-G-X2-X3-S-X5-G-X6-X7-X8-X9,     (SEQ ID NO: 9), wherein

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:9 by as many as 1 but no more than 2, 3, 4, or 5 residues.

In an embodiment, the N-terminal RuvC-like domain comprises an amino acid sequence of formula III:

D-I-G-X2-X3-S-V-G-W-A-X8-X9     (SEQ ID NO: 10), wherein

X2 is selected from T, I, V, S, N, Y, E and L (e.g., selected from T, V, and I);

X3 is selected from N, S, G, A, D, T, R, M and F (e.g., A or N);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:10 by as many as 1 but no more than, 2, 3, 4, or 5 residues.

In an embodiment, the N-terminal RuvC-like domain comprises an amino acid sequence of formula III:

D-I-G-T-N-S-V-G-W-A-V-X     (SEQ ID NO: 11), wherein

X is a non-polar alkyl amino acid or a hydroxyl amino acid, e.g., X is selected from V, I, L and T (e.g., the eaCas9 molecule can comprise an N-terminal RuvC-like domain shown in FIGS. 2A-2G (is depicted as Y)).

In an embodiment, the N-terminal RuvC-like domain differs from a sequence of SEQ ID NO:11 by as many as 1 but no more than, 2, 3, 4, or 5 residues.

In an embodiment, the N-terminal RuvC-like domain differs from a sequence of an N-terminal RuvC like domain disclosed herein, e.g., in FIGS. 3A-3B or FIGS. 7A-7B, as many as 1 but no more than 2, 3, 4, or 5 residues. In an embodiment, 1, 2, 3 or all of the highly conserved residues identified in FIGS. 3A-3B or FIGS. 7A-7B are present.

In an embodiment, the N-terminal RuvC-like domain differs from a sequence of an N-terminal RuvC-like domain disclosed herein, e.g., in FIGS. 4A-4B or FIGS. 7A-7B, as many as 1 but no more than 2, 3, 4, or 5 residues. In an embodiment, 1, 2, or all of the highly conserved residues identified in FIGS. 4A-4B or FIGS. 7A-7B are present.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:

I-X1-X2-E-X3-A-R-E     (SEQ ID NO:12), wherein

X1 is V or H,

X2 is I, L or V (e.g., I or V); and

X3 is M or T.

In an embodiment, the additional RuvC-like domain comprises the amino acid sequence:

I-V-X2-E-M-A-R-E (SEQ ID NO:13), wherein

X2 is I, L or V (e.g., I or V) (e.g., the eaCas9 molecule or eaCas9 polypeptide can comprise an additional RuvC-like domain shown in FIG. 2A-2G or FIGS. 7A-7B (depicted as B)).

An additional RuvC-like domain can comprise an amino acid sequence:

H-H-A-X1-D-A-X2-X3 (SEQ ID NO:14), wherein

X1 is H or L;
X2 is R or V; and
X3 is E or V.

In an embodiment, the additional RuvC-like domain comprises the amino acid sequence: H-H-A-H-D-A-Y-L (SEQ ID NO:15).

In an embodiment, the additional RuvC-like domain differs from a sequence of SEQ ID NO:13, 15, 12 or 14 by as many as 1 but no more than 2, 3, 4, or 5 residues.

In some embodiments, the sequence flanking the N-terminal RuvC-like domain is a sequences of formula V:

K-X1'-Y-X2'-X3'-X4'-Z-T-D-X9'-Y, (SEQ ID NO:16).

wherein
X1' is selected from K and P,
X2' is selected from V, L, I, and F (e.g., V, I and L);
X3' is selected from G, A and S (e.g., G),
X4' is selected from L, I, V and F (e.g., L);
X9' is selected from D, E, N and Q; and
Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

X1-X2-X3-H-X4-X5-P-X6-X7-X8-X9-X10-X11-
X12-X13-X14-X15-N-X16-X17-X18-X19-X20-
X21-X22-X23-N (SEQ ID NO:17), wherein X1 is selected from D, E, Q and N (e.g., D and E);
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X7 is selected from S, A, D, T and K (e.g., S and A);
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X11 is selected from D, S, N, R, L and T (e.g., D);
X12 is selected from D, N and S;
X13 is selected from S, A, T, G and R (e.g., S);
X14 is selected from I, L, F, S, R, Y, Q, W, D, K and H (e.g., I, L and F);
X15 is selected from D, S, I, N, E, A, H, F, L, Q, M, G, Y and V;
X16 is selected from K, L, R, M, T and F (e.g., L, R and K);
X17 is selected from V, L, I, A and T;
X18 is selected from L, I, V and A (e.g., L and I);
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, a HNH-like domain differs from a sequence of SEQ ID NO:17 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

X1-X2-X3-H-X4-X5-P-X6-S-X8-X9-X10-D-D-S-
X14-X15-N—K-V-L-X19-X20-X21-X22-
X23-N (SEQ ID NO:18), wherein
X1 is selected from D and E;
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO:18 by 1, 2, 3, 4, or 5 residues.

In an embodiment, an eaCas9 molecule or eaCas9 polypeptide comprises an HNH-like domain comprising an amino acid sequence of formula VII:

X1-V-X3-H-I-V-P-X6-S-X8-X9-X10-D-D-S-X14-
X15-N—K-V-L-T-X20-X21-X22-X23-N (SEQ ID NO:19), wherein
X1 is selected from D and E;
X3 is selected from D and E;
X6 is selected from Q, H, R, K, Y, I, L and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);

X15 is selected from D, S, I, N, E, A, H, F, L, Q, M, G, Y and V;

X20 is selected from R, F, T, W, E, L, N, C, K, V, S, Q, I, Y, H and A;

X21 is selected from S, P, R, K, N, A, H, Q, G and L;

X22 is selected from D, G, T, N, S, K, A, I, E, L, Q, R and Y; and

X23 is selected from K, V, A, E, Y, I, C, L, S, T, G, K, M, D and F.

In an embodiment, the HNH-like domain differs from a sequence of SEQ ID NO:19 by 1, 2, 3, 4, or 5 residues.

In an embodiment, an eaCas9 molecule or eaCas9 polypeptide comprises an HNH-like domain having an amino acid sequence of formula VIII:

D-X2-D-H-I-X5-P-Q-X7-F-X9-X10-D-X12-S-I-D-N-X16-V-L-X19-X20-S-X22-X23-N    (SEQ ID NO:20), wherein X2 is selected from I and V;
X5 is selected from I and V;
X7 is selected from A and S;
X9 is selected from I and L;
X10 is selected from K and T;
X12 is selected from D and N;
X16 is selected from R, K and L; X19 is selected from T and V;
X20 is selected from S and R;
X22 is selected from K, D and A; and
X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO:20 by as many as 1 but no more than 2, 3, 4, or 5 residues.

In an embodiment, an eaCas9 molecule or eaCas9 polypeptide comprises the amino acid sequence of formula IX:

X9'-K-X10'-D-X11'-V-P    (SEQ ID NO:21), wherein

X1' is selected from K and R;
X2' is selected from V and T;
X3' is selected from G and D;
X4' is selected from E, Q and D;
X5' is selected from E and D;
X6' is selected from D, N and H;
X7' is selected from Y, R and N;
X8' is selected from Q, D and N; X9' is selected from G and E;
X10' is selected from S and G;
X11' is selected from D and N; and
Z is an HNH-like domain, e.g., as described above.

In an embodiment, the eaCas9 molecule or eaCas9 polypeptide comprises an amino acid sequence that differs from a sequence of SEQ ID NO:21 by as many as 1 but no more than 2, 3, 4, or 5 residues.

In an embodiment, the HNH-like domain differs from a sequence of an HNH-like domain disclosed herein, e.g., in FIGS. 5A-5C or FIGS. 7A-7B, as many as 1 but no more than 2, 3, 4, or 5 residues. In an embodiment, 1 or both of the highly conserved residues identified in FIGS. 5A-5C or FIGS. 7A-7B are present.

In an embodiment, the HNH-like domain differs from a sequence of an HNH-like domain disclosed herein, e.g., in FIGS. 6A-6B or FIGS. 7A-7B, as many as 1 but no more than 2, 3, 4, or 5 residues. In an embodiment, 1, 2, all 3 of the highly conserved residues identified in FIGS. 6A-6B or FIGS. 7A-7B are present.

Cas9 Activities

Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 peolypeptide which is a nickase, or which lacks the ability to cleave target nucleic acid. A Cas9 molecule or Cas9 polypeptide that is capable of cleaving a target nucleic acid molecule is referred to herein as an eaCas9 molecule or eaCas9 polypeptide. In an embodiment, an eaCas9 molecule or Cas9 polypeptide comprises one or more of the following activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double stranded break, which in a embodiment is the presence of two nickase activities;

an endonuclease activity;

an exonuclease activity; and a helicase activity, i.e., the ability to unwind the helical structure of a double stranded nucleic acid.

In an embodiment, an enzymatically active Cas9 or eaCas9 molecule or eaCas9 polypeptide cleaves both strands and results in a double stranded break. In an embodiment, an eaCas9 molecule cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH-like domain. In an embodiment, an eaCas9 molecule or eaCas9 polypeptide comprises cleavage activity associated with an N-terminal RuvC-like domain. In an embodiment, an eaCas9 molecule or eaCas9 polypeptide comprises cleavage activity associated with an HNH-like domain and cleavage activity associated with an N-terminal RuvC-like domain. In an embodiment, an eaCas9 molecule or eaCas9 polypeptide comprises an active, or cleavage competent, HNH-like domain and an inactive, or cleavage incompetent, N-terminal RuvC-like domain. In an embodiment, an eaCas9 molecule or eaCas9 polypeptide comprises an inactive, or cleavage incompetent, HNH-like domain and an active, or cleavage competent, N-terminal RuvC-like domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain and PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. eaCas9 molecules from different bacterial species can recognize different sequence motifs (e.g., PAM sequences). In an embodiment, an eaCas9 molecule of *S. pyogenes* recognizes the sequence motif NGG and directs cleavage of a target nucleic acid sequence 1 to 10, e.g., 3 to 5, base pairs upstream from that sequence. See, e.g., Mali et al., SCIENCE 2013; 339(6121): 823-826. In an embodiment, an eaCas9 molecule of *S. thermophilus* recognizes the sequence motif NGGNG and NNAGAAW (W=A or T) and directs cleavage of a core target nucleic acid sequence 1 to 10, e.g., 3 to 5, base pairs upstream from these sequences. See, e.g., Horvath et al., SCIENCE 2010; 327(5962):167-170, and Deveau et al., J BACTERIOL 2008; 190(4): 1390-1400. In an embodiment, an eaCas9 molecule of *S. mutans* recognizes the sequence motif NGG and/or NAAR (R=A or G) and directs cleavage of a core target nucleic acid sequence 1 to 10, e.g., 3 to 5 base pairs, upstream from this sequence. See, e.g., Deveau et al., J BACTERIOL 2008; 190(4): 1390-1400. In an embodiment, an eaCas9 molecule of *S. aureus* recognizes the sequence motif NNGRR (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRN (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRT (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRV (R=A or G, V=A, G or C) and directs cleavage of a target nucleic acid sequence 1 to 10, e.g., 3 to 5, base pairs upstream from that sequence. In an embodiment, an eaCas9 molecule of *Neisseria meningitidis* recognizes the sequence motif NNNNGATT or NNNGCTT and directs cleavage of a target nucleic acid sequence 1 to 10, e.g., 3 to 5 base pairs upstream from that sequence. See, e.g., Hou et al., PNAS Early Edition 2013, 1-6. The ability of a Cas9 molecule to recognize a PAM sequence can be determined, e.g., using a transformation assay described in Jinek et al., SCIENCE 2012 337:816. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski et al., RNA BIOLOGY 2013 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Another exemplary Cas9 molecule is a Cas9 molecule of *Neisseria meningitides* (Hou et al., PNAS Early Edition 2013, 1-6.

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 85%, 90%, 95%, 96%, 97%, 98% or 99% homology with;

differs at no more than, 2, 5, 10, 15, 20, 30, or 40% of the amino acid residues when compared with;

differs by at least 1, 2, 5, 10 or 20 amino acids but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al., RNA BIOLOGY 2013 10:5, 727-737; Hou et al., PNAS Early Edition 2013, 1-6; e.g., SEQ ID NOs:1-4. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to home to a target nucleic acid.

In an embodiment, a Cas9 molecule or Cas9 polypeptide comprises any of the amino acid sequence of the consensus sequence of FIGS. 2A-2G, wherein "*" indicates any amino acid found in the corresponding position in the amino acid sequence of a Cas9 molecule of *S. pyogenes, S. thermophilus, S. mutans* and *L. innocua*, and "-" indicates any amino acid. In an embodiment a Cas9 molecule or Cas9 polypeptide differs from the sequence of the consensus sequence disclosed in FIGS. 2A-2G by at least 1, but no more than 2, 3, 4, 5, 6, 7, 8, 9, or 10 amino acid residues. In an embodiment, a Cas9 molecule or Cas9 polypeptide comprises the amino acid sequence of SEQ ID NO:7 of FIGS. 7A-7B, wherein "*" indicates any amino acid found in the corresponding position in the amino acid sequence of a Cas9 molecule of S. pyogenes, or N. meningitides, "-" indicates any amino acid, and "-" indicates any amino acid or absent. In an embodiment, a Cas9 molecule or Cas9 polypeptide differs from the sequence of SEQ ID NO:6 or 7 disclosed in FIGS. 7A-7B by at least 1, but no more than 2, 3, 4, 5, 6, 7, 8, 9, or 10 amino acid residues.

A comparison of the sequence of a number of Cas9 molecules indicate that certain regions are conserved. These are identified below as:

region 1 (residues 1 to 180, or in the case of region 1'residues 120 to 180)

region 2 (residues 360 to 480);

region 3 (residues 660 to 720);

region 4 (residues 817 to 900); and region 5 (residues 900 to 960);

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-6, independently, have, 50%, 60%, 70%, or 80% homology with the corresponding residues of a Cas9 molecule or Cas9 polypeptide described herein, e.g., a sequence from FIG. 2A-2G or from FIGS. 7A-7B.

In an embodiment, a Cas9 molecule or Cas9 polypeptide, e.g., an eaCas9 molecule or eaCas9 polypeptide, comprises an amino acid sequence referred to as region 1:

having 50%, 60%, 70%, 80%, 85%, 90%, 95%, 96%, 97%, 98% or 99% homology with amino acids 1-180 (the numbering is according to the motif sequence in FIGS. 2A-2G; 52% of residues in the four Cas9 sequences in FIGS. 2A-2G are conserved) of the amino acid sequence of Cas9 of S. pyogenes;

differs by at least 1, 2, 5, 10 or 20 amino acids but by no more than 90, 80, 70, 60, 50, 40 or 30 amino acids from amino acids 1-180 of the amino acid sequence of Cas9 of S. pyogenes, S. thermophilus, S. mutans or Listeria innocua; or is identical to 1-180 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 1': having 55%, 60%, 65%, 70%, 75%, 80%, 85%, 90%, 95%, 96%, 97%, 98% or 99% homology with amino acids 120-180 (55% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 120-180 of the amino acid sequence of Cas9 of S. pyogenes, S. thermophilus, S. mutans or L. innocua; or is identical to 120-180 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 2:

having 50%, 55%, 60%, 65%, 70%, 75%, 80%, 85%, 90%, 95%, 96%, 97%, 98%, or 99% homology with amino acids 360-480 (52% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 360-480 of the amino acid sequence of Cas9 of S. pyogenes, S. thermophilus, S. mutans or L. innocua; or is identical to 360-480 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 3:

having 55%, 60%, 65%, 70%, 75%, 80%, 85%, 90%, 95%, 96%, 97%, 98%, or 99% homology with amino acids 660-720 (56% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 660-720 of the amino acid sequence of Cas9 of S. pyogenes, S. thermophilus, S. mutans or L. innocua; or is identical to 660-720 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 4:

having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 817-900 of the amino acid sequence of Cas9 of S. pyogenes, S. thermophilus, S. mutans or L. innocua; or is identical to 817-900 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 5:

having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 900-960 of the amino acid sequence of Cas9 of S. pyogenes, S. thermophilus, S. mutans or L. innocua; or is identical to 900-960 of the amino acid sequence of Cas9 of S. pyogenes, S. thermophilus, S. mutans or L. innocua.

Engineered or Altered Cas9 Molecules and Cas9 Polypeptides

Cas9 molecules and Cas9 polypeptides described herein, e.g., naturally occurring Cas9 molecules, can possess any of a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecules or Cas9 polypeptide can include all or a subset of these properties. In typical embodiments, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. E.g., an engineered Cas9 molecule can be altered to recognize a PAM sequence other than that recognized by the endogenous wild-type PI domain. In an embodiment, a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring Cas9 molecules or Cas9 polypeptides to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40 or 50 mutations, but less than 200, 100, or 80 mutations relative to a reference, e.g., a parental, Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of S. pyogenes, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of S. pyogenes); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of S. pyogenes); or the ability to cleave a nucleic acid molecule, e.g., a double stranded or single stranded nucleic acid molecule, can be eliminated.

Modified Cleavage eaCas9 Molecules and eaCas9 Polypeptides

In an embodiment, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In an embodiment, an eaCas9 molecule or eaCas9 polypeptide comprises an active, or cleavage competent, HNH-like domain (e.g., an HNH-like domain described herein, e.g., SEQ ID NO:17, SEQ ID NO:18, SEQ ID NO:19, SEQ ID NO:20 or SEQ ID NO: 21) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 2A-2G or an aspartic acid at position 10 of SEQ ID NO:7, e.g., can be substituted with an alanine. In an embodiment, the eaCas9 molecule or eaCas9 polypeptide differs from wild type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, or S. thermophilus. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., an HNH-like domain described herein, e.g., SEQ ID NO:8, SEQ ID NO:9, SEQ ID NO:10, SEQ ID NO:11, SEQ ID NO:12, SEQ ID NO:13, SEQ ID NO:14 or SEQ ID NO:15). Exemplary inactive, or cleavage incompetent HNH-like domains can have a mutation at one or more of: a histidine in an HNH-like domain, e.g., a histidine shown at position 856 of the consensus sequence disclosed in FIGS. 2A-2G, e.g., can be substituted with an alanine; and one or more asparagines in an HNH-like domain, e.g., an asparagine shown at position 870 of the consensus sequence disclosed in FIGS. 2A-2G and/or at position 879 of the consensus sequence disclosed in FIGS. 2A-2G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, or S. thermophilus. In an embodiment, the reference Cas9 molecule is the naturally occurring Cas9 molecule having the closest sequence identity or homology.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in one or more RuvC-like domain, e.g., an N-terminal RuvC-like domain; an HNH-like domain; a region outside the RuvC-like domains and the HNH-like domain. In some embodiments, a mutation(s) is present in a RuvC-like domain, e.g., an N-terminal RuvC-like domain. In some embodiments, a mutation(s) is present in an HNH-like domain. In some embodiments, mutations are present in both aRuvC-like domain, e.g., an N-terminal RuvC-like domain and an HNH-like domain.

Exemplary mutations that may be made in the RuvC domain or HNH domain with reference to the S. pyogenes sequence include: D10A, E762A, H840A, N854A, N863A and/or D986A.

In an embodiment, a Cas9 molecule or Cas9 polypeptide is an eiCas9 molecule or eiCas9 polypeptide comprising one or more differences in a RuvC domain and/or in an HNH domain as compared to a reference Cas9 molecule, and the eiCas9 molecule or eiCas9 polypeptide does not cleave a nucleic acid, or cleaves with significantly less efficiency than does wildtype, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc, can be evaluated or predicted, e.g., by evaluating whether the mutation is conservative or by the method described in Section IV. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of S aureus, S. pyogenes, or C. jejuni as follows: its ability to modulate, e.g., decreased or increased, cleavage of a double stranded break (endonuclease and/or exonuclease activity), e.g., as compared to a naturally occurring Cas9 molecule (e.g., a Cas9 molecule of S aureus, S. pyogenes, or C. jejuni); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of S aureus, S. pyogenes, or C. jejuni); or the ability to cleave a nucleic acid molecule, e.g., a double stranded or single stranded nucleic acid molecule, can be eliminated.

In an embodiment, the altered Cas9 molecule or Cas9 polypeptide is an eaCas9 molecule or eaCas9 polypeptide comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule or Cas9 polypeptide is an eiCas9 molecule or eiCas9 polypeptide which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of S. pyogenes, S. thermophilus, S. aureus, C. jejuni or N. meningitidis. In an embodiment, the reference Cas9 molecule is the naturally occurring Cas9 molecule having the closest sequence identity or homology. In an embodiment, the eiCas9 molecule or eiCas9 polypeptide lacks substantial cleavage activity associated with a RuvC domain and cleavage activity associated with an HNH domain.

In an embodiment, the altered Cas9 molecule or Cas9 polypeptide is an eaCas9 molecule or eaCas9 polypeptide comprising the fixed amino acid residues of S. pyogenes shown in the consensus sequence disclosed in FIGS. 2A-2G, and has one or more amino acids that differ from the amino acid sequence of S. pyogenes (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G or SEQ ID NO:7.

In an embodiment, the altered Cas9 molecule or Cas9 polypeptide comprises a sequence in which:
the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;
the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. pyogenes Cas9 molecule; and,
the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. pyogenes Cas9 molecule.

In an embodiment, the altered Cas9 molecule or Cas9 polypeptide is an eaCas9 molecule or eaCas9 polypeptide comprising the fixed amino acid residues of S. thermophilus shown in the consensus sequence disclosed in FIGS. 2A-2G, and has one or more amino acids that differ from the amino acid sequence of S. thermophilus (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment the altered Cas9 molecule or Cas9 polypeptide comprises a sequence in which:
the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;
the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. thermophilus Cas9 molecule; and,
the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. thermophilus Cas9 molecule.

In an embodiment, the altered Cas9 molecule or Cas9 polypeptide is an eaCas9 molecule or eaCas9 polypeptide comprising the fixed amino acid residues of S. mutans shown in the consensus sequence disclosed in FIGS. 2A-2G, and has one or more amino acids that differ from the amino acid sequence of S. mutans (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. mutans Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. mutans Cas9 molecule.

In an embodiment, the altered Cas9 molecule or Cas9 polypeptide is an eaCas9 molecule or eaCas9 polypeptide comprising the fixed amino acid residues of L. innocula shown in the consensus sequence disclosed in FIGS. 2A-2G, and has one or more amino acids that differ from the amino acid sequence of L. innocula (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an L. innocula Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an L. innocula Cas9 molecule.

In an embodiment, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of Cas9 molecule of S. pyogenes comprising an N-terminal RuvC-like domain can be fused to a fragment of Cas9 molecule of a species other than S. pyogenes (e.g., S. thermophilus) comprising an HNH-like domain.

Cas9 Molecules and Cas9 Polypeptides with Altered PAM Recognition or No PAM Recognition Naturally occurring Cas9 molecules can recognize specific PAM sequences, for example the PAM recognition sequences described above for S. pyogenes, S. thermophilus and S. mutans.

In an embodiment, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to high level of identity (e.g., 98%, 99% or 100% match between gRNA and a PAM sequence), e.g., to decrease off target sites and increase specificity. In an embodiment, the length of the PAM recognition sequence is at least 4, 5, 6, 7, 8, 9, 10 or 15 amino acids in length. In an embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. NATURE 2011, 472(7344): 499-503. Candidate Cas9 molecules can be evaluated, e.g., by methods described in Section IV.

Alterations of the PI domain, which mediates PAM recognition, are discussed below.

Synthetic Cas9 Molecules and Cas9 Polypeptides with Altered PI Domains

Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or Syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule or Syn-Cas9 polypeptide comprises:

a) a Cas9 core domain, e.g., a Cas9 core domain from Table 7 or 8, e.g., a S. aureus, S. pyogenes, or C. jejuni Cas9 core domain; and b) an altered PI domain from a species X Cas9 sequence selected from Tables 10 and 11.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table 7 and said altered PI domain comprises a PI domain from a species Y Cas9 from Table 7.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 90, 95, or 100% homology with the amino acid sequence of a naturally occurring PI domain of said species Y from Table 7.

In an embodiment, the altered PI domain differs by no more than 50, 40, 30, 25, 20, 15, 10, 5, 4, 3, 2, or 1 amino acid residue from the amino acid sequence of a naturally occurring PI domain of said second species from Table 7.

In an embodiment, the Cas9 core domain comprises a S. aureus core domain and altered PI domain comprises: an A. denitrificans PI domain; a C. jejuni PI domain; a H. mustelae PI domain; or an altered PI domain of species X PI domain, wherein species X is selected from Table 11.

In an embodiment, the Cas9 core domain comprises a S. pyogenes core domain and the altered PI domain comprises: an A. denitrificans PI domain; a C. jejuni PI domain; a H. mustelae PI domain; or an altered PI domain of species X PI domain, wherein species X is selected from Table 11.

In an embodiment, the Cas9 core domain comprises a C. jejuni core domain and the altered PI domain comprises: an A. denitrificans PI domain; a H. mustelae PI domain; or an altered PI domain of species X PI domain, wherein species X is selected from Table 11.

In an embodiment, the Cas9 molecule or Cas9 polypeptide further comprises a linker disposed between said Cas9 core domain and said altered PI domain.

In an embodiment, the linker comprises: a linker described elsewhere herein disposed between the Cas9 core domain and the heterologous PI domain. Suitable linkers are further described in Section V.

Exemplary altered PI domains for use in Syn-Cas9 molecules are described in Tables 10 and 11. The sequences for the 83 Cas9 orthologs referenced in Tables 10 and 11 are provided in Table 7. Table 9 provides the Cas9 orthologs with known PAM sequences and the corresponding RKR motif.

In an embodiment, a Syn-Cas9 molecule or Syn-Cas9 polypeptide may also be size-optimized, e.g., the Syn-Cas9 molecule or Syn-Cas9 polypeptide comprises one or more deletions, and optionally one or more linkers disposed between the amino acid residues flanking the deletions. In an embodiment, a Syn-Cas9 molecule or Syn-Cas9 polypeptide comprises a REC deletion.

Size-Optimized Cas9 Molecules and Cas9 Polypeptides

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a S. aureus, S. pyogenes, or C. jejuni, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule or Cas9 polypeptide can comprise one or more deletions that do not substantially affect or decrease the activity of the resultant Cas9 molecules or Cas9 polypeptides described herein. Activities that are retained in the Cas9 molecules or Cas9 polypeptides comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules or Cas9 polypeptides described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 7, can be modeled onto the crystal structure of S. pyogenes Cas9 (Nishimasu et al., Cell, 156:935-949, 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

REC-Optimized Cas9 Molecules and Cas9 Polypeptides

A REC-optimized Cas9 molecule, or a REC-optimized Cas9 polypeptide, as that term is used herein, refers to a Cas9 molecule or Cas9 polypeptide that comprises a deletion in one or both of the REC2 domain and the $RE1_{CT}$ domain (collectively a REC deletion), wherein the deletion comprises at least 10% of the amino acid residues in the cognate domain. A REC-optimized Cas9 molecule or Cas9 polypeptide can be an eaCas9 molecule or eaCas9 polypeptide, or an eiCas9 molecule or eiCas9 polypeptide. An exemplary REC-optimized Cas9 molecule or REC-optimized Cas9 polypeptide comprises:

a) a deletion selected from:

i) a REC2 deletion;

ii) a $REC1_CT$ deletion; or iii) a REC1 $S_tB$ deletion.

Optionally, a linker is disposed between the amino acid residues that flank the deletion. In an embodiment, a Cas9 molecule or Cas9 polypeptide includes only one deletion, or only two deletions. A Cas9 molecule or Cas9 polypeptide can comprise a REC2 deletion and a $REC1_CT$ deletion. A Cas9 molecule or Cas9 polypeptide can comprise a REC2 deletion and a REC1 $S_{U}B$ deletion.

Generally, the deletion will contain at least 10% of the amino acids in the cognate domain, e.g., a REC2 deletion will include at least 10% of the amino acids in the REC2 domain.

A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule or REC-optimized Cas9 polypeptide can include a linker disposed between the amino acid residues that flank the deletion. Any linkers known in the art that maintain the conformation or native fold of the Cas9 molecule (thereby retaining Cas9 activity) can be used between the amino acid resides that flank a REC deletion in a REC-optimized Cas9 molecule or REC-optimized Cas9 polypeptide. Linkers for use in generating recombinant proteins, e.g., multi-domain proteins, are known in the art (Chen et al., Adv Drug Delivery Rev, 65:1357-69, 2013).

In an embodiment, a REC-optimized Cas9 molecule or REC-optimized Cas9 polypeptide comprises an amino acid sequence that, other than any REC deletion and associated linker, has at least 50, 55, 60, 65, 70, 75, 80, 85, 90, 95, 99, or 100% homology with the amino acid sequence of a naturally occurring Cas 9, e.g., a Cas9 molecule described in Table 7, e.g., a S. aureus Cas9 molecule, a S. pyogenes Cas9 molecule, or a C. jejuni Cas9 molecule.

In an embodiment, a a REC-optimized Cas9 molecule or REC-optimized Cas9 polypeptide comprises an amino acid sequence that, other than any REC deletion and associated linker, differs by no more than 1, 2, 3, 4, 5, 6, 7, 8, 9, 10, 15, 20, or 25, amino acid residues from the amino acid sequence of a naturally occurring Cas 9, e.g., a Cas9 molecule described in Table 7, e.g., a S. aureus Cas9 molecule, a S. pyogenes Cas9 molecule, or a C. jejuni Cas9 molecule.

In an embodiment, a REC-optimized Cas9 molecule or REC-optimized Cas9 polypeptide comprises an amino acid sequence that, other than any REC deletion and associate linker, differs by no more than 1, 2, 3, 4, 5, 6, 7, 8, 9, 10, 15, 20, or 25% of the, amino acid residues from the amino acid sequence of a naturally occurring Cas 9, e.g., a Cas9 molecule described in Table 7, e.g., a S. aureus Cas9 molecule, a S. pyogenes Cas9 molecule, or a C. jejuni Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table 7.

The amino acid sequences of exemplary Cas9 molecules from different bacterial species are shown below.

TABLE 7

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| Staphylococcus Aureus tr\|J7RUA5\|J7RUA5_STAAU | SEQ ID NO: 26 | 126 | 166 | 41 | 296 | 352 | 57 | 296 | 352 | 57 |

TABLE 7-continued

Amino Acid Sequence of Cas9 Orthologs

| Species/Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| *Streptococcus Pyogenes* sp|Q99ZW2|CAS9_STRP1 | SEQ ID NO: 7 | 176 | 314 | 139 | 511 | 592 | 82 | 511 | 592 | 82 |
| *Campylobacter jejuni* NCTC 11168 gi|218563121|ref|YP_002344900.1| | SEQ ID NO: 306 | 137 | 181 | 45 | 316 | 360 | 45 | 316 | 360 | 45 |
| *Bacteroides fragilis* NCTC 9343 gi|60683389|ref|YP_213533.1| | SEQ ID NO: 307 | 148 | 339 | 192 | 524 | 617 | 84 | 524 | 617 | 84 |
| *Bifidobacterium bifidum* S17 gi|310286728|ref|YP_003937986. | SEQ ID NO: 308 | 173 | 335 | 163 | 516 | 607 | 87 | 516 | 607 | 87 |
| *Veillonella atypica* ACS-134-V-Col7a gi|303229466|ref|ZP_07316256.1 | SEQ ID NO: 309 | 185 | 339 | 155 | 574 | 663 | 79 | 574 | 663 | 79 |
| *Lactobacillus rhamnosus* GG gi|258509199|ref|YP_003171950.1 | SEQ ID NO: 310 | 169 | 320 | 152 | 559 | 645 | 78 | 559 | 645 | 78 |
| *Filifactor alocis* ATCC 35896 gi|374307738|ref|YP_005054169.1 | SEQ ID NO: 311 | 166 | 314 | 149 | 508 | 592 | 76 | 508 | 592 | 76 |
| *Oenococcus kitaharae* DSM 17330 gi|366983953|gb|EHN59352.1| | SEQ ID NO: 312 | 169 | 317 | 149 | 555 | 639 | 80 | 555 | 639 | 80 |
| *Fructobacillus fructosus* KCTC 3544 gi|339625081|ref|ZP_08660870.1 | SEQ ID NO: 313 | 168 | 314 | 147 | 488 | 571 | 76 | 488 | 571 | 76 |
| *Catenibacterium mitsuokai* DSM 15897 gi|224543312|ref|ZP_03683851.1 | SEQ ID NO: 314 | 173 | 318 | 146 | 511 | 594 | 78 | 511 | 594 | 78 |
| *Finegoldia magna* ATCC 29328 gi|169823755|ref|YP_001691366.1 | SEQ ID NO: 315 | 168 | 313 | 146 | 452 | 534 | 77 | 452 | 534 | 77 |
| *Coriobacterium glomerans* PW2 gi|328956315|ref|YP_004373648.1 | SEQ ID NO: 316 | 175 | 318 | 144 | 511 | 592 | 82 | 511 | 592 | 82 |
| *Eubacterium yurii* ATCC 43715 gi|306821691|ref|ZP_07455288.1 | SEQ ID NO: 317 | 169 | 310 | 142 | 552 | 633 | 76 | 552 | 633 | 76 |
| *Peptoniphilus duerdenii* ATCC BAA-1640 gi|304438954|ref|ZP_07398877.1 | SEQ ID NO: 318 | 171 | 311 | 141 | 535 | 615 | 76 | 535 | 615 | 76 |
| *Acidaminococcus* sp. D21 gi|227824983|ref|ZP_03989815.1 | SEQ ID NO: 319 | 167 | 306 | 140 | 511 | 591 | 75 | 511 | 591 | 75 |
| *Lactobacillus farciminis* KCTC 3681 gi|336394882|ref|ZP_08576281.1 | SEQ ID NO: 320 | 171 | 310 | 140 | 542 | 621 | 85 | 542 | 621 | 85 |
| *Streptococcus sanguinis* SK49 gi|422884106|ref|ZP_16930555.1 | SEQ ID NO: 321 | 185 | 324 | 140 | 411 | 490 | 85 | 411 | 490 | 85 |
| *Coprococcus catus* GD-7 gi|291520705|emb|CBK78998.1| | SEQ ID NO: 322 | 172 | 310 | 139 | 556 | 634 | 76 | 556 | 634 | 76 |
| *Streptococcus mutans* UA159 gi|24379809|ref|NP_721764.1| | SEQ ID NO: 323 | 176 | 314 | 139 | 392 | 470 | 84 | 392 | 470 | 84 |
| *Streptococcus pyogenes* M1 GAS gi|13622193|gb|AAK33936.1| | SEQ ID NO: 7 | 176 | 314 | 139 | 523 | 600 | 82 | 523 | 600 | 82 |
| *Streptococcus thermophilus* LMD-9 gi|116628213|ref|YP_820832.1| | SEQ ID NO: 325 | 176 | 314 | 139 | 481 | 558 | 81 | 481 | 558 | 81 |
| *Fusobacterium nucleatum* ATCC49256 gi|34762592|ref|ZP_00143587.1| | SEQ ID NO: 326 | 171 | 308 | 138 | 537 | 614 | 76 | 537 | 614 | 76 |
| *Planococcus antarcticus* DSM 14505 gi|389815359|ref|ZP_10206685.1 | SEQ ID NO: 327 | 162 | 299 | 138 | 538 | 614 | 94 | 538 | 614 | 94 |
| *Treponema denticola* ATCC 35405 gi|42525843|ref|NP_970941.1| | SEQ ID NO: 328 | 169 | 305 | 137 | 524 | 600 | 81 | 524 | 600 | 81 |
| *Solobacterium moorei* F0204 gi|320528778|ref|ZP_08029929.1 | SEQ ID NO: 329 | 179 | 314 | 136 | 544 | 619 | 77 | 544 | 619 | 77 |
| *Staphylococcus pseudintermedius* ED99 gi|323463801|gb|ADX75954.1| | SEQ ID NO: 330 | 164 | 299 | 136 | 531 | 606 | 92 | 531 | 606 | 92 |
| *Flavobacterium branchiophilum* FL-15 gi|347536497|ref|YP_004843922.1 | SEQ ID NO: 331 | 162 | 286 | 125 | 538 | 613 | 63 | 538 | 613 | 63 |
| *Ignavibacterium album* JCM 16511 gi|385811609|ref|YP_005848005.1 | SEQ ID NO: 332 | 223 | 329 | 107 | 357 | 432 | 90 | 357 | 432 | 90 |

TABLE 7-continued

Amino Acid Sequence of Cas9 Orthologs

| Species/Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| *Bergeyella zoohelcum* ATCC 43767 gi\|423317190\|ref\|ZP_17295095.1 | SEQ ID NO: 333 | 165 | 261 | 97 | 529 | 604 | 56 | 529 | 604 | 56 |
| *Nitrobacter hamburgensis* X14 gi\|92109262\|ref\|YP_571550.1\| | SEQ ID NO: 334 | 169 | 253 | 85 | 536 | 611 | 48 | 536 | 611 | 48 |
| *Odoribacter laneus* YIT 12061 gi\|374384763\|ref\|ZP_09642280.1 | SEQ ID NO: 335 | 164 | 242 | 79 | 535 | 610 | 63 | 535 | 610 | 63 |
| *Legionella pneumophila* str. Paris gi\|54296138\|ref\|YP_122507.1\| | SEQ ID NO: 336 | 164 | 239 | 76 | 402 | 476 | 67 | 402 | 476 | 67 |
| *Bacteroides* sp. 20_3 gi\|301311869\|ref\|ZP_07217791.1 | SEQ ID NO: 337 | 198 | 269 | 72 | 530 | 604 | 83 | 530 | 604 | 83 |
| *Akkermansia muciniphila* ATCC BAA-835 gi\|187736489\|ref\|YP_001878601. | SEQ ID NO: 338 | 136 | 202 | 67 | 348 | 418 | 62 | 348 | 418 | 62 |
| *Prevotella* sp. C561 gi\|345885718\|ref\|ZP_08837074.1 | SEQ ID NO: 339 | 184 | 250 | 67 | 357 | 425 | 78 | 357 | 425 | 78 |
| *Wolinella succinogenes* DSM 1740 gi\|34557932\|ref\|NP_907747.1\| | SEQ ID NO: 340 | 157 | 218 | 36 | 401 | 468 | 60 | 401 | 468 | 60 |
| *Alicyclobacillus hesperidum* URH17-3-68 gi\|403744858\|ref\|ZP_10953934.1 | SEQ ID NO: 341 | 142 | 196 | 55 | 416 | 482 | 61 | 416 | 482 | 61 |
| *Caenispirillum salinarum* AK4 gi\|427429481\|ref\|ZP_18919511.1 | SEQ ID NO: 342 | 161 | 214 | 54 | 330 | 393 | 68 | 330 | 393 | 68 |
| *Eubacterium rectale* ATCC 33656 gi\|238924075\|ref\|YP_002937591.1 | SEQ ID NO: 343 | 133 | 185 | 53 | 322 | 384 | 60 | 322 | 384 | 60 |
| *Mycoplasma synoviae* 53 gi\|71894592\|ref\|YP_278700.1\| | SEQ ID NO: 344 | 187 | 239 | 53 | 319 | 381 | 80 | 319 | 381 | 80 |
| *Porphyromonas* sp. oral taxon 279 str. F0450 gi\|402847315\|ref\|ZP_10895610.1 | SEQ ID NO: 345 | 150 | 202 | 53 | 309 | 371 | 60 | 309 | 371 | 60 |
| *Streptococcus thermophilus* LMD-9 gi\|116627542\|ref\|YP_820161.1\| | SEQ ID NO: 346 | 127 | 178 | 139 | 424 | 486 | 81 | 424 | 486 | 81 |
| *Roseburia inulinivorans* DSM 16841 gi\|225377804\|ref\|ZP_03755025.1 | SEQ ID NO: 347 | 154 | 204 | 51 | 318 | 380 | 69 | 318 | 380 | 69 |
| *Methylosinus trichosporium* OB3b gi\|296446027\|ref\|ZP_06887976.1 | SEQ ID NO: 348 | 144 | 193 | 50 | 426 | 488 | 64 | 426 | 488 | 64 |
| *Ruminococcus albus* 8 gi\|325677756\|ref\|ZP_08157403.1 | SEQ ID NO: 349 | 139 | 187 | 49 | 351 | 412 | 55 | 351 | 412 | 55 |
| *Bifidobacterium longum* DJO10A gi\|189440764\|ref\|YP_001955845. | SEQ ID NO: 350 | 183 | 230 | 48 | 370 | 431 | 44 | 370 | 431 | 44 |
| *Enterococcus faecalis* TX0012 gi\|315149830\|gb\|EFT93846.1\| | SEQ ID NO: 351 | 123 | 170 | 48 | 327 | 387 | 60 | 327 | 387 | 60 |
| *Mycoplasma mobile* 163K gi\|47458868\|ref\|YP_015730.1\| | SEQ ID NO: 352 | 179 | 226 | 48 | 314 | 374 | 79 | 314 | 374 | 79 |
| *Actinomyces coleocanis* DSM 15436 gi\|227494853\|ref\|ZP_03925169.1 | SEQ ID NO: 353 | 147 | 193 | 47 | 358 | 418 | 40 | 358 | 418 | 40 |
| *Dinoroseobacter shibae* DFL 12 gi\|159042956\|ref\|YP_001531750.1 | SEQ ID NO: 354 | 138 | 184 | 47 | 338 | 398 | 48 | 338 | 398 | 48 |
| *Actinomyces* sp. oral taxon 180 str. F0310 gi\|315605738\|ref\|ZP_07880770.1 | SEQ ID NO: 355 | 183 | 228 | 46 | 349 | 409 | 40 | 349 | 409 | 40 |
| *Alcanivorax* sp. W11-5 gi\|407803669\|ref\|ZP_11150502.1 | SEQ ID NO: 356 | 139 | 183 | 45 | 344 | 404 | 61 | 344 | 404 | 61 |
| *Aminomonas paucivorans* DSM 12260 gi\|312879015\|ref\|ZP_07738815.1 | SEQ ID NO: 357 | 134 | 178 | 45 | 341 | 401 | 63 | 341 | 401 | 63 |
| *Mycoplasma canis* PG 14 gi\|384393286\|gb\|EIE39736.1\| | SEQ ID NO: 358 | 139 | 183 | 45 | 319 | 379 | 76 | 319 | 379 | 76 |
| *Lactobacillus coryniformis* KCTC 3535 gi\|336393381\|ref\|ZP_08574780.1 | SEQ ID NO: 359 | 141 | 184 | 44 | 328 | 387 | 61 | 328 | 387 | 61 |
| *Elusimicrobium minutum* Pei191 gi\|187250660\|ref\|YP_001875142.1 | SEQ ID NO: 360 | 177 | 219 | 43 | 322 | 381 | 47 | 322 | 381 | 47 |

TABLE 7-continued

Amino Acid Sequence of Cas9 Orthologs

| Species/Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| Neisseria meningitidis Z2491 gi\|218767588\|ref\|YP_002342100.1\| | SEQ ID NO: 25 | 147 | 189 | 43 | 360 | 419 | 61 | 360 | 419 | 61 |
| Pasteurella multocida str. Pm70 gi\|15602992\|ref\|NP_246064.1\| | SEQ ID NO: 362 | 139 | 181 | 43 | 319 | 378 | 61 | 319 | 378 | 61 |
| Rhodovulum sp. PH10 gi\|402849997\|ref\|ZP_10898214.1\| | SEQ ID NO: 363 | 141 | 183 | 43 | 319 | 378 | 48 | 319 | 378 | 48 |
| Eubacterium dolichum DSM 3991 gi\|160915782\|ref\|ZP_02077990.1\| | SEQ ID NO: 364 | 131 | 172 | 42 | 303 | 361 | 59 | 303 | 361 | 59 |
| Nitratifractor salsuginis DSM 16511 gi\|319957206\|ref\|YP_004168469.1\| | SEQ ID NO: 365 | 143 | 184 | 42 | 347 | 404 | 61 | 347 | 404 | 61 |
| Rhodospirillum rubrum ATCC 11170 gi\|83591793\|ref\|YP_425545.1\| | SEQ ID NO: 366 | 139 | 180 | 42 | 314 | 371 | 55 | 314 | 371 | 55 |
| Clostridium cellulolyticum H10 gi\|220930482\|ref\|YP_002507391.1\| | SEQ ID NO: 367 | 137 | 176 | 40 | 320 | 376 | 61 | 320 | 376 | 61 |
| Helicobacter mustelae 12198 gi\|291276265\|ref\|YP_003516037.1\| | SEQ ID NO: 368 | 148 | 187 | 40 | 298 | 354 | 48 | 298 | 354 | 48 |
| Ilyobacter polytropus DSM 2926 gi\|310780384\|ref\|YP_003968716.1\| | SEQ ID NO: 369 | 134 | 173 | 40 | 462 | 517 | 63 | 462 | 517 | 63 |
| Sphaerochaeta globus str. Buddy gi\|325972003\|ref\|YP_004248194.1\| | SEQ ID NO: 370 | 163 | 202 | 40 | 335 | 389 | 45 | 335 | 389 | 45 |
| Staphylococcus lugdunensis M23590 gi\|315659848\|ref\|ZP_07912707.1\| | SEQ ID NO: 371 | 128 | 167 | 40 | 337 | 391 | 57 | 337 | 391 | 57 |
| Treponema sp. JC4 gi\|384109266\|ref\|ZP_10010146.1\| | SEQ ID NO: 372 | 144 | 183 | 40 | 328 | 382 | 63 | 328 | 382 | 63 |
| uncultured delta proteobacterium HF0070 07E19 gi\|297182908\|gb\|ADI19058.1\| | SEQ ID NO: 373 | 154 | 193 | 40 | 313 | 365 | 55 | 313 | 365 | 55 |
| Alicycliphilus denitrificans K601 gi\|330822845\|ref\|YP_004386148.1\| | SEQ ID NO: 374 | 140 | 178 | 39 | 317 | 366 | 48 | 317 | 366 | 48 |
| Azospirillum sp. B510 gi\|288957741\|ref\|YP_003448082.1\| | SEQ ID NO: 375 | 205 | 243 | 39 | 342 | 389 | 46 | 342 | 389 | 46 |
| Bradyrhizobium sp. BTAi1 gi\|148255343\|ref\|YP_001239928.1\| | SEQ ID NO: 376 | 143 | 181 | 39 | 323 | 370 | 48 | 323 | 370 | 48 |
| Parvibaculum lavamentivorans DS-1 gi\|154250555\|ref\|YP_001411379.1\| | SEQ ID NO: 377 | 138 | 176 | 39 | 327 | 374 | 58 | 327 | 374 | 58 |
| Prevotella timonensis CRIS 5C-B1 gi\|282880052\|ref\|ZP_06288774.1\| | SEQ ID NO: 378 | 170 | 208 | 39 | 328 | 375 | 61 | 328 | 375 | 61 |
| Bacillus smithii 7 3 47FAA gi\|365156657\|ref\|ZP_09352959.1\| | SEQ ID NO: 379 | 134 | 171 | 38 | 401 | 448 | 63 | 401 | 448 | 63 |
| Cand. Puniceispirillum marinum IMCC1322 gi\|294086111\|ref\|YP_003552871.1\| | SEQ ID NO: 380 | 135 | 172 | 38 | 344 | 391 | 53 | 344 | 391 | 53 |
| Barnesiella intestinihominis YIT 11860 gi\|404487228\|ref\|ZP_11022414.1\| | SEQ ID NO: 381 | 140 | 176 | 37 | 371 | 417 | 60 | 371 | 417 | 60 |
| Ralstonia syzygii R24 gi\|344171927\|emb\|CCA84553.1\| | SEQ ID NO: 382 | 140 | 176 | 37 | 395 | 440 | 50 | 395 | 440 | 50 |
| Wolinella succinogenes DSM 1740 gi\|34557790\|ref\|NP_907605.1\| | SEQ ID NO: 383 | 145 | 180 | 36 | 348 | 392 | 60 | 348 | 392 | 60 |
| Mycoplasma gallisepticum str. F gi\|284931710\|gb\|ADC31648.1\| | SEQ ID NO: 384 | 144 | 177 | 34 | 373 | 416 | 71 | 373 | 416 | 71 |
| Acidothermus cellulolyticus 11B gi\|117929158\|ref\|YP_873709.1\| | SEQ ID NO: 385 | 150 | 182 | 33 | 341 | 380 | 58 | 341 | 380 | 58 |
| Mycoplasma ovipneumoniae SC01 gi\|363542550\|ref\|ZP_09312133.1\| | SEQ ID NO: 386 | 156 | 184 | 29 | 381 | 420 | 62 | 381 | 420 | 62 |

TABLE 8

Amino Acid Sequence of Cas9 Core Domains

| Strain Name | Cas9 Start (AA pos) Start and Stop numbers refer to the sequence in Table 7 | Cas9 Stop (AA pos) |
|---|---|---|
| Staphylococcus Aureus (SEQ ID NO: 304) | 1 | 772 |
| Streptococcus Pyogenes (SEQ ID NO: 7) | 1 | 1099 |
| Campulobacter Jejuni | 1 | 741 |

TABLE 9

Identified PAM sequences and corresponding RKR motifs.

| Strain Name | PAM sequence (NA) | RKR motif (AA) |
|---|---|---|
| Streptococcus pyogenes | NGG | RKR |
| Streptococcus mutans | NGG | RKR |
| Streptococcus thermophilus A | NGGNG | RYR |
| Treponema denticola | NAAAAN | VAK |
| Streptococcus thermophilus B | NNAAAAW | IYK |
| Campylobacter jejuni | NNNNACA | NLK |
| Pasteurella multocida | GNNNCNNA | KDG |
| Neisseria meningitidis | NNNNGATT or | IGK |
| Staphylococcus aureus | NNGRRV (R = A or G; V = A, G or C) NNGRRT (R = A or G) | NDK |

PI domains are provided in Tables 10 and 11.

TABLE 10

Altered PI Domains

| Strain Name | PI Start (AA pos) Start and Stop numbers refer to the sequences in Table 100 | PI Stop (AA pos) | Length of PI (AA) | RKR motif (AA) |
|---|---|---|---|---|
| Alicycliphilus denitrificans K601 | 837 | 1029 | 193 | —Y |
| Campylobacter jejuni NCTC 11168 | 741 | 984 | 244 | —NG |
| Helicobacter mustelae 12198 | 771 | 1024 | 254 | —NQ |

TABLE 11

Other Altered PI Domains

| Strain Name | PI Start (AA pos) Start and Stop numbers refer to the sequences in Table 7 | PI Stop (AA pos) | Length of PI (AA) | RKR motif (AA) |
|---|---|---|---|---|
| Akkermansia muciniphila ATCC BAA-835 | 871 | 1101 | 231 | ALK |
| Ralstonia syzygii R24 | 821 | 1062 | 242 | APY |
| Cand. Puniceispirillum marinum IMCC1322 | 815 | 1035 | 221 | AYK |
| Fructobacillus fructosus KCTC 3544 | 1074 | 1323 | 250 | DGN |
| Eubacterium yurii ATCC 43715 | 1107 | 1391 | 285 | DGY |
| Eubacterium dolichum DSM 3991 | 779 | 1096 | 318 | DKK |
| Dinoroseobacter shibae DFL 12 | 851 | 1079 | 229 | DPI |
| Clostridium cellulolyticum H10 | 767 | 1021 | 255 | EGK |
| Pasteurella multocida str. Pm70 | 815 | 1056 | 242 | ENN |
| Mycoplasma canis PG 14 | 907 | 1233 | 327 | EPK |
| Porphyromonas sp. oral taxon 279 str. F0450 | 935 | 1197 | 263 | EPT |
| Filifactor alocis ATCC 35896 | 1094 | 1365 | 272 | EVD |
| Aminomonas paucivorans DSM 12260 | 801 | 1052 | 252 | EVY |
| Wolinella succinogenes DSM 1740 | 1034 | 1409 | 376 | EYK |
| Oenococcus kitaharae DSM 17330 | 1119 | 1389 | 271 | GAL |
| Coriobacterium glomerans PW2 | 1126 | 1384 | 259 | GDR |
| Peptoniphilus duerdenii ATCC BAA-1640 | 1091 | 1364 | 274 | GDS |
| Bifidobacterium bifidum S17 | 1138 | 1420 | 283 | GGL |
| Alicyclobacillus hesperidum URH17-3-68 | 876 | 1146 | 271 | GGR |
| Roseburia inulinivorans DSM 16841 | 895 | 1152 | 258 | GGT |
| Actinomyces coleocanis DSM 15436 | 843 | 1105 | 263 | GKK |
| Odoribacter laneus YIT 12061 | 1103 | 1498 | 396 | GKV |
| Coprococcus catus GD-7 | 1063 | 1338 | 276 | GNQ |
| Enterococcus faecalis TX0012 | 829 | 1150 | 322 | GRK |
| Bacillus smithii 7 3 47FAA | 809 | 1088 | 280 | GSK |
| Legionella pneumophila str. Paris | 1021 | 1372 | 352 | GTM |
| Bacteroides fragilis NCTC 9343 | 1140 | 1436 | 297 | IPV |
| Mycoplasma ovipneumoniae SC01 | 923 | 1265 | 343 | IRI |
| Actinomyces sp. oral taxon 180 str. F0310 | 895 | 1181 | 287 | KEK |
| Treponema sp. JC4 | 832 | 1062 | 231 | KIS |
| Fusobacterium nucleatum ATCC49256 | 1073 | 1374 | 302 | KKV |
| Lactobacillus farciminis KCTC 3681 | 1101 | 1356 | 256 | KKV |
| Nitratifractor salsuginis DSM 16511 | 840 | 1132 | 293 | KMR |

TABLE 11-continued

Other Altered PI Domains

| Strain Name | PI Start (AA pos) Start and Stop numbers refer to the sequences in Table 7 | PI Stop (AA pos) | Length of PI (AA) | RKR motif (AA) |
|---|---|---|---|---|
| Lactobacillus coryniformis KCTC 3535 | 850 | 1119 | 270 | KNK |
| Mycoplasma mobile 163K | 916 | 1236 | 321 | KNY |
| Flavobacterium branchiophilum FL-15 | 1182 | 1473 | 292 | KQK |
| Prevotella timonensis CRIS 5C-B1 | 957 | 1218 | 262 | KQQ |
| Methylosinus trichosporium OB3b | 830 | 1082 | 253 | KRP |
| Prevotella sp. C561 | 1099 | 1424 | 326 | KRY |
| Mycoplasma gallisepticum str. F | 911 | 1269 | 359 | KTA |
| Lactobacillus rhamnosus GG | 1077 | 1363 | 287 | KYG |
| Wolinella succinogenes DSM 1740 | 811 | 1059 | 249 | LPN |
| Streptococcus thermophilus LMD-9 | 1099 | 1388 | 290 | MLA |
| Treponema denticola ATCC 35405 | 1092 | 1395 | 304 | NDS |
| Bergeyella zoohelcum ATCC 43767 | 1098 | 1415 | 318 | NEK |
| Veillonella atypica ACS-134-V-Col7a | 1107 | 1398 | 292 | NGF |
| Neisseria meningitidis Z2491 | 835 | 1082 | 248 | NHN |
| Ignavibacterium album JCM 16511 | 1296 | 1688 | 393 | NKK |
| Ruminococcus albus 8 | 853 | 1156 | 304 | NNF |
| Streptococcus thermophilus LMD-9 | 811 | 1121 | 311 | NNK |
| Barnesiella intestinihominis YIT 11860 | 871 | 1153 | 283 | NPV |
| Azospirillum sp. B510 | 911 | 1168 | 258 | PFH |
| Rhodospirillum rubrum ATCC 11170 | 863 | 1173 | 311 | PRG |
| Planococcus antarcticus DSM 14505 | 1087 | 1333 | 247 | PYY |
| Staphylococcus pseudintermedius ED99 | 1073 | 1334 | 262 | QIV |
| Alcanivorax sp. W11-5 | 843 | 1113 | 271 | RIE |
| Bradyrhizobium sp. BTAi1 | 811 | 1064 | 254 | RIY |
| Streptococcus pyogenes M1 GAS | 1099 | 1368 | 270 | RKR |
| Streptococcus mutans UA159 | 1078 | 1345 | 268 | RKR |
| Streptococcus Pyogenes | 1099 | 1368 | 270 | RKR |
| Bacteroides sp. 20 3 | 1147 | 1517 | 371 | RNI |
| S. aureus | 772 | 1053 | 282 | RNK |
| Solobacterium moorei F0204 | 1062 | 1327 | 266 | RSG |
| Finegoldia magna ATCC 29328 | 1081 | 1348 | 268 | RTE |
| uncultured delta proteobacterium HF0070 07E19 | 770 | 1011 | 242 | SGG |
| Acidaminococcus sp. D21 | 1064 | 1358 | 295 | SIG |
| Eubacterium rectale ATCC 33656 | 824 | 1114 | 291 | SKK |
| Caenispirillum salinarum AK4 | 1048 | 1442 | 395 | SLV |
| Acidothermus cellulolyticus 11B | 830 | 1138 | 309 | SPS |
| Catenibacterium mitsuokai DSM 15897 | 1068 | 1329 | 262 | SPT |
| Parvibaculum lavamentivorans DS-1 | 827 | 1037 | 211 | TGN |
| Staphylococcus lugdunensis M23590 | 772 | 1054 | 283 | TKK |
| Streptococcus sanguinis SK49 | 1123 | 1421 | 299 | TRM |
| Elusimicrobium minutum Pei191 | 910 | 1195 | 286 | TTG |
| Nitrobacter hamburgensis X14 | 914 | 1166 | 253 | VAY |
| Mycoplasma synoviae 53 | 991 | 1314 | 324 | VGF |
| Sphaerochaeta globus str. Buddy | 877 | 1179 | 303 | VKG |
| Ilyobacter polytropus DSM 2926 | 837 | 1092 | 256 | VNG |
| Rhodovulum sp. PH10 | 821 | 1059 | 239 | VPY |
| Bifidobacterium longum DJO10A | 904 | 1187 | 284 | VRK |

Amino acid sequences described in Table 7 (in order of appearance):

SEQ ID NO: 304

MKRNYILGLDIGITSVGYGIIDYETRDVIDAGVRLFKEANVENNEGRRSKRGARRLKRRRRHRI

QRVKKLLFDYNLLTDHSELSGINPYEARVKGLSQKLSEEEFSAALLHLAKRRGVHNVNEVEEDT

GNELSTKEQISRNSKALEEKYVAELQLERLKKDGEVRGSINRFKTSDYVKEAKQLLKVQKAYHQ

LDQSFIDTYIDLLETRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVNEEDIKGYRVTSTGK

PEFTNLKVYHDIKDITARKEIIENAELLDQIAKILTIYQSSEDIQEELTNLNSELTQEEIEQIS

NLKGYTGTHNLSLKAINLILDELWHTNDNQIAIFNRLKLVPKKVDLSQQKEIPTTLVDDFILSP

VVKRSFIQSIKVINAIIKKYGLPNDIIIELAREKNSKDAQKMINEMQKRNRQTNERIEEIIRTT

-continued

```
GKENAKYLIEKIKLHDMQEGKCLYSLEAIPLEDLLNNPFNYEVDHIIPRSVSFDNSFNNKVLVK

QEENSKKGNRTPFQYLSSSDSKISYETFKKHILNLAKGKGRISKTKKEYLLEERDINRFSVQKD

FINRNLVDTRYATRGLMNLLRSYFRVNNLDVKVKSINGGFTSFLRRKWKFKKERNKGYKHHAED

ALIIANADFIFKEWKKLDKAKKVMENQMFEEKQAESMPEIETEQEYKEIFITPHQIKHIKDFKD

YKYSHRVDKKPNRELINDTLYSTRKDDKGNTLIVNNLNGLYDKDNDKLKKLINKSPEKLLMYHH

DPQTYQKLKLIMEQYGDEKNPLYKYYEETGNYLTKYSKKDNGPVIKKIKYYGNKLNAHLDITDD

YPNSRNKVVKLSLKPYRFDVYLDNGVYKFVTVKNLDVIKKENYYEVNSKCYEEAKKLKKISNQA

EFIASFYNNDLIKINGELYRVIGVNNDLLNRIEVNMIDITYREYLENMNDKRPPRIIKTIASKT

QSIKKYSTDILGNLYEVKSKKHPQIIKKG
```

SEQ ID NO: 7
```
MDKKYSIGLDIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
```

SEQ ID NO: 306
```
MARILAFDIGISSIGWAFSENDELKDCGVRIFTKVENPKTGESLALPRRLARSARKRLARRKAR

LNHLKHLIANEFKLNYEDYQSFDESLAKAYKGSLISPYELRFRALNELLSKQDFARVILHIAKR

RGYDDIKNSDDKEKGAILKAIKQNEEKLANYQSVGEYLYKEYFQKFKENSKEFTNVRNKKESYE

RCIAQSFLKDELKLIFKKQREFGFSFSKKFEEEVLSVAFYKRALKDFSHLVGNCSFFTDEKRAP

KNSPLAFMFVALTRIINLLNNLKNTEGILYTKDDLNALLNEVLKNGTLTYKQTKKLLGLSDDYE

FKGEKGTYFIEFKKYKEFIKALGEHNLSQDDLNEIAKDITLIKDEIKLKKALAKYDLNQNQIDS

LSKLEFKDHLNISFKALKLVTPLMLEGKKYDEACNELNLKVAINEDKKDFLPAFNETYYKDEVT

NPVVLRAIKEYRKVLNALLKKYGKVHKINIELAREVGKNHSQRAKIEKEQNENYKAKKDAELEC

EKLGLKINSKNILKLRLFKEQKEFCAYSGEKIKISDLQDEKMLEIDHIYPYSRSFDDSYMNKVL
```

-continued

VFTKQNQEKLNQTPFEAFGNDSAKWQKIEVLAKNLPTKKQKRILDKNYKDKEQKNFKDRNLNDT

RYIARLVLNYTKDYLDFLPLSDDENTKLNDTQKGSKVHVEAKSGMLTSALRHTWGFSAKDRNNH

LHHAIDAVIIAYANNSIVKAFSDFKKEQESNSAELYAKKISELDYKNKRKFFEPFSGFRQKVLD

KIDEIFVSKPERKKPSGALHEETFRKEEEFYQSYGGKEGVLKALELGKIRKVNGKIVKNGDMFR

VDIFKHKKTNKFYAVPIYTMDFALKVLPNKAVARSKKGEIKDWILMDENYEFCFSLYKDSLILI

QTKDMQEPEFVYYNAFTSSTVSLIVSKHDNKFETLSKNQKILFKNANEKEVIAKSIGIQNLKVF

EKYIVSALGEVTKAEFRQREDFKK

SEQ ID NO: 307
MKRILGLDLGTNSIGWALVNEAENKDERSSIVKLGVRVNPLTVDELTNFEKGKSITTNADRTLK

RGMRRNLQRYKLRRETLTEVLKEHKLITEDTILSENGNRTTFETYRLRAKAVTEEISLEEFARV

LLMINKKRGYKSSRKAKGVEEGTLIDGMDIARELYNNNLTPGELCLQLLDAGKKFLPDFYRSDL

QNELDRIWEKQKEYYPEILTDVLKEELRGKKRDAVWAICAKYFVWKENYTEWNKEKGKTEQQER

EHKLEGIYSKRKRDEAKRENLQWRVNGLKEKLSLEQLVIVFQEMNTQINNSSGYLGAISDRSKE

LYFNKQTVGQYQMEMLDKNPNASLRNMVFYRQDYLDEFNMLWEKQAVYHKELTEELKKEIRDII

IFYQRRLKSQKGLIGFCEFESRQIEVDIDGKKKIKTVGNRVISRSSPLFQEFKIWQILNNIEVT

VVGKKRKRRKLKENYSALFEELNDAEQLELNGSRRLCQEEKELLAQELFIRDKMTKSEVLKLLF

DNPQELDLNFKTIDGNKTGYALFQAYSKMIEMSGHEPVDFKKPVEKVVEYIKAVFDLLNWNTDI

LGFNSNEELDNQPYYKLWHLLYSFEGDNTPTGNGRLIQKMTELYGFEKEYATILANVSFQDDYG

SLSAKAIHKILPHLKEGNRYDVACVYAGYRHSESSLTREEIANKVLKDRLMLLPKNSLHNPVVE

KILNQMVNVINVIIDIYGKPDEIRVELARELKKNAKEREELTKSIAQTTKAHEEYKTLLQTEFG

LTNVSRTDILRYKLYKELESCGYKTLYSNTYISREKLFSKEFDIEHIIPQARLFDDSFSNKTLE

ARSVNIEKGNKTAYDFVKEKFGESGADNSLEHYLNNIEDLFKSGKISKTKYNKLKMAEQDIPDG

FIERDLRNTQYIAKKALSMLNEISHRVVATSGSVTDKLREDWQLIDVMKELNWEKYKALGLVEY

FEDRDGRQIGRIKDWTKRNDHRHHAMDALTVAFTKDVFIQYFNNKNASLDPNANEHAIKNKYFQ

NGRAIAPMPLREFRAEAKKHLENTLISIKAKNKVITGNINKTRKKGGVNKNMQQTPRGQLHLET

IYGSGKQYLTKEEKVNASFDMRKIGTVSKSAYRDALLKRLYENDNDPKKAFAGKNSLDKQPIWL

DKEQMRKVPEKVKIVTLEAIYTIRKEISPDLKVDKVIDVGVRKILIDRLNEYGNDAKKAFSNLD

KNPIWLNKEKGISIKRVTISGISNAQSLHVKKDKDGKPILDENGRNIPVDFVNTGNNHHVAVYY

RPVIDKRGQLVVDEAGNPKYELEEVVVSFFEAVTRANLGLPIIDKDYKTTEGWQFLFSMKQNEY

FVFPNEKTGFNPKEIDLLDVENYGLISPNLFRVQKFSLKNYVFRHHLETTIKDTSSILRGITWI

DFRSSKGLDTIVKVRVNHIGQIVSVGEY

SEQ ID NO: 308
MSRKNYVDDYAISLDIGNASVGWSAFTPNYRLVRAKGHELIGVRLFDPADTAESRRMARTTRRR

YSRRRWRLRLLDALFDQALSEIDPSFLARRKYSWVHPDDENNADCWYGSVLFDSNEQDKRFYEK

YPTIYHLRKALMEDDSQHDIREIYLAIHHMVKYRGNFLVEGTLESSNAFKEDELLKLLGRITRY

EMSEGEQNSDIEQDDENKLVAPANGQLADALCATRGSRSMRVDNALEALSAVNDLSREQRAIVK

AIFAGLEGNKLDLAKIFVSKEFSSENKKILGIYFNKSDYEEKCVQIVDSGLLDDEEREFLDRMQ

GQYNAIALKQLLGRSTSVSDSKCASYDAHRANWNLIKQLRTKENEKDINENYGILVGWKIDSG

QRKSVRGESAYENMRKKANVFFKKMIETSDLSETDKNRLIHDIEEDKLFPIQRDSDNGVIPHQL

HQNELKQIIKKQGKYYPFLLDAFEKDGKQINKIEGLLTFRVPYFVGPLVVPEDLQKSDNSENHW

MVRKKKGEITPWNFDEMVDKDASGRKFIERLVGTDSYLLGEPTLPKNSLLYQEYEVLNELNNVR

-continued

LSVRTGNHWNDKRRMRLGREEKTLLCQRLFMKGQTVTKRTAENLLRKEYGRTYELSGLSDESKF

TSSLSTYGKMCRIFGEKYVNEHRDLMEKIVELQTVFEDKETLLHLRQLEGISEADCALLVNTH

YTGWGRLSRKLLTTKAGECKISDDFAPRKHSIIEIMRAEDRNLMEIITDKQLGFSDWIEQENLG

AENGSSLMEVVDDLRVSPKVKRGIIQSIRLIDDISKAVGKRPSRIFLELADDIQPSGRTISRKS

RLQDLYRNANLGKEFKGIADELNACSDKDLQDDRLFLYYTQLGKDMYTGEELDLRLSSAYDID

HIIPQAVTQNDSIDNRVLVARAENARKTDSFTYMPQIADRMRNFWQILLDNGLISRVKFERLTR

QNEFSEREKERFVQRSLVETRQIMKNVATLMRQRYGNSAAVIGLNAELTKEMHRYLGFSHKNRD

INDYHHAQDALCVGIAGQFAANRGFFADGEVSDGAQNSYNQYLRDYLRGYREKLSAEDRKQGRA

FGFIVGSMRSQDEQKRVNPRTGEVVWSEEDKDYLRKVMNYRKMLVTQKVGDDFGALYDETRYAA

TDPKGIKGIPFDGAKQDTSLYGGFSSAKPAYAVLIESKGKTRLVNVTMQEYSLLGDRPSDDELR

KVLAKKKSEYAKANILLRHVPKMQLIRYGGGLMVIKSAGELNNAQQLWLPYEEYCYFDDLSQGK

GSLEKDDLKKLLDSILGSVQCLYPWHRFTEEELADLHVAFDKLPEDEKKNVITGIVSALHADAK

TANLSIVGMTGSWRRMNNKSGYTFSDEDEFIFQSPSGLFEKRVTVGELKRKAKKEVNSKYRTNE

KRLPTLSGASQP

SEQ ID NO: 309
METQTSNQLITSHLKDYPKQDYFVGLDIGTNSVGWAVTNTSYELLKFHSHKMWGSRLFEEGESA

VTRRGFRSMRRRLERRKLRLKLLEELFADAMAQVDSTFFIRLHESKYHYEDKTTGHSSKHILFI

DEDYTDQDYFTEYPTIYHLRKDLMENGTDDIRKLFLAVHHILKYRGNFLYEGATFNSNAFTFED

VLKQALVNITFNCFDTNSAISSISNILMESGKTKSDKAKAIERLVDTYTVFDEVNTPDKPQKEQ

VKEDKKTLKAFANLVLGLSANLIDLFGSVEDIDDDLKKLQIVGDTYDEKRDELAKVWGDEIHII

DDCKSVYDAIILMSIKEPGLTISQSKVKAFDKHKEDLVILKSLLKLDRNVYNEMFKSDKKGLHN

YVHYIKQGRTEETSCSREDFYKYTKKIVEGLADSKDKEYILNEIELQTLLPLQRIKDNGVIPYQ

LHLEELKVILDKCGPKFPFLHTVSDGFSVTEKLIKMLEFRIPYYVGPLNTHHNIDNGGFSWAVR

KQAGRVTPWNFEEKIDREKSAAAFIKNLTNKCTYLFGEDVLPKSSLLYSEFMLLNELNNVRIDG

KALAQGVKQHLIDSIFKQDHKKMTKNRIELFLKDNNYITKKHKPEITGLDGEIKNDLTSYRDMV

RILGNNFDVSMAEDIITDITIFGESKKMLRQTLRNKFGSQLNDETIKKLSKLRYRDWGRLSKKL

LKGIDGCDKAGNGAPKTIIELMRNDSYNLMEILGDKFSFMECIEEENAKLAQGQVVNPHDIIDE

LALSPAVKRAVWQALRIVDEVAHIKKALPSRIFVEVARTNKSEKKKKDSRQKRLSDLYSAIKKD

DVLQSGLQDKEFGALKSGLANYDDAALRSKKLYLYYTQMGRCAYTGNIIDLNQLNTDNYDIDHI

YPRSLTKDDSFDNLVLCERTANAKKSDIYPIDNRIQTKQKPFWAFLKHQGLISERKYERLTRIA

PLTADDLSGFIARQLVETNQSVKATTTLLRRLYPDIDVVFVKAENVSDFRHNNNFIKVRSLNHH

HHAKDAYLNIVVGNVYHEKFTRNFRLFFKKNGANRTYNLAKMFNYDVICTNAQDGKAWDVKTSM

NTVKKMMASNDVRVTRRLLEQSGALADATIYKASVAAKAKDGAYIGMKTKYSVFADVTKYGGMT

KIKNAYSIIVQYTGKKGEEIKEIVPLPIYLINRNATDIELIDYVKSVIPKAKDISIKYRKLCIN

QLVKVNGFYYYLGGKTNDKIYIDNAIELVVPHDIATYIKLLDKYDLLRKENKTLKASSITTSIY

NINTSTVVSLNKVGIDVFDYFMSKLRTPLYMKMKGNKVDELSSTGRSKFIKMTLEEQSIYLLEV

LNLLTNSKTTFDVKPLGITGSRSTIGVKIHNLDEFKIINESITGLYSNEVTIV

SEQ ID NO: 310
MTKLNQPYGIGLDIGSNSIGFAVVDANSHLLRLKGETAIGARLFREGQSAADRRGSRTTRRRLS

RTRWRLSFLRDFFAPHITKIDPDFFLRQKYSEISPKDKDRFKYEKRLFNDRTDAEFYEDYPSMY

HLRLHLMTHTHKADPREIFLAIHHILKSRGHFLTPGAAKDFNTDKVDLEDIFPALTEAYAQVYP

DLELTFDLAKADDFKAKLLDEQATPSDTQKALVNLLLSSDGEKEIVKKRKQVLTEFAKAITGLK

-continued

TKFNLALGTEVDEADASNWQFSMGQLDDKWSNIETSMTDQGTEIFEQIQELYRARLLNGIVPAG

MSLSQAKVADYGQHKEDLELFKTYLKKLNDHELAKTIRGLYDRYINGDDAKPFLREDFVKALTK

EVTAHPNEVSEQLLNRMGQANFMLKQRTKANGAIPIQLQQRELDQIIANQSKYYDWLAAPNPVE

AHRWKMPYQLDELLNFHIPYYVGPLITPKQQAESGENVFAWMVRKDPSGNITPYNFDEKVDREA

SANTFIQRMKTTDTYLIGEDVLPKQSLLYQKYEVLNELNNVRINNECLGTDQKQRLIREVFERH

SSVTIKQVADNLVAHGDFARRPEIRGLADEKRFLSSLSTYHQLKEILHEAIDDPTKLLDIENII

TWSTVFEDHTIFETKLAEIEWLDPKKINELSGIRYRGWGQFSRKLLDGLKLGNGHTVIQELMLS

NHNLMQILADETLKETMTELNQDKLKTDDIEDVINDAYTSPSNKKALRQVLRVVEDIKHAANGQ

DPSWLFIETADGTGTAGKRTQSRQKQIQTVYANAAQELIDSAVRGELEDKIADKASFTDRLVLY

FMQGGRDIYTGAPLNIDQLSHYDIDHILPQSLIKDDSLDNRVLVNATINREKNNVFASTLFAGK

MKATWRKWHEAGLISGRKLRNLMLRPDEIDKFAKGFVARQLVETRQIIKLTEQIAAAQYPNTKI

IAVKAGLSHQLREELDFPKNRDVNHYHHAFDAFLAARIGTYLLKRYPKLAPFFTYGEFAKVDVK

KFREFNFIGALTHAKKNIIAKDTGEIVWDKERDIRELDRIYNFKRMLITHEVYFETADLFKQTI

YAAKDSKERGGSKQLIPKKQGYPTQVYGGYTQESGSYNALVRVAEADTTAYQVIKISAQNASKI

ASANLKSREKGKQLLNEIVVKQLAKRRKNWKPSANSFKIVIPRFGMGTLFQNAKYGLFMVNSDT

YYRNYQELWLSRENQKLLKKLFSIKYEKTQMNHDALQVYKAIIDQVEKFFKLYDINQFRAKLSD

AIERFEKLPINTDGNKIGKTETLRQILIGLQANGTRSNVKNLGIKTDLGLLQVGSGIKLDKDTQ

IVYQSPSGLFKRRIPLADL

SEQ ID NO: 311
MTKEYYLGLDVGTNSVGWAVTDSQYNLCKFKKKDMWGIRLFESANTAKDRRLQRGNRRRLERKK

QRIDLLQEIFSPEICKIDPTFFIRLNESRLHLEDKSNDFKYPLFIEKDYSDIEYYKEFPTIFHL

RKHLIESEEKQDIRLIYLALHNIIKTRGHFLIDGDLQSAKQLRPILDTFLLSLQEEQNLSVSLS

ENQKDEYEEILKNRSIAKSEKVKKLKNLFEISDELEKEEKKAQSAVIENFCKFIVGNKGDVCKF

LRVSKEELEIDSFSFSEGKYEDDIVKNLEEKVPEKVYLFEQMKAMYDWNILVDILETEEYISFA

KVKQYEKHKTNLRLLRDIILKYCTKDEYNRMFNDEKEAGSYTAYVGKLKKNNKKYWIEKKRNPE

EFYKSLGKLLDKIEPLKEDLEVLTMMIEECKNHTLLPIQKNKDNGVIPHQVHEVELKKILENAK

KYYSFLTETDKDGYSVVQKIESIFRFRIPYYVGPLSTRHQEKGSNVWMVRKPGREDRIYPWNME

EIIDFEKSNENFITRMTNKCTYLIGEDVLPKHSLLYSKYMVLNELNNVKVRGKKLPTSLKQKVF

EDLFENKSKVTGKNLLEYLQIQDKDIQIDDLSGFDKDFKTSLKSYLDFKKQIFGEEIEKESIQN

MIEDIIKWITIYGNDKEMLKRVIRANYSNQLTEEQMKKITGFQYSGWGNFSKMFLKGISGSDVS

TGETFDIITAMWETDNNLMQILSKKFTFMDNVEDFNSGKVGKIDKITYDSTVKEMFLSPENKRA

VWQTIQVAEEIKKVMGCEPKKIFIEMARGGEKVKKRTKSRKAQLLELYAACEEDCRELIKEIED

RDERDFNSMKLFLYYTQFGKCMYSGDDIDINELIRGNSKWDRDHIYPQSKIKDDSIDNLVLVNK

TYNAKKSNELLSEDIQKKMHSFWLSLLNKKLITKSKYDRLTRKGDFTDEELSGFIARQLVETRQ

STKAIADIFKQIYSSEVVYVKSSLVSDFRKKPLNYLKSRRVNDYHHAKDAYLNIVVGNVYNKKF

TSNPIQWMKKNRDTNYSLNKVFEHDVVINGEVIWEKCTYHEDTNTYDGGTLDRIRKIVERDNIL

YTEYAYCEKGELFNATIQNKNGNSTVSLKKGLDVKKYGGYFSANTSYFSLIEFEDKKGDRARHI

IGVPIYIANMLEHSPSAFLEYCEQKGYQNVRILVEKIKKNSLLIINGYPLRIRGENEVDTSFKR

AIQLKLDQKNYELVRNIEKFLEKYVEKKGNYPIDENRDHITHEKMNQLYEVLLSKMKKFNKKGM

ADPSDRIEKSKPKFIKLEDLIDKINVINKMLNLLRCDNDTKADLSLIELPKNAGSFVVKKNTIG

KSKIILVNQSVTGLYENRREL

SEQ ID NO: 312
MARDYSVGLDIGTSSVGWAAIDNKYHLIRAKSKNLIGVRLFDSAVTAEKRRGYRTTRRRLSRRH

WRLRLLNDIFAGPLTDFGDENFLARLKYSWVHPQDQSNQAHFAAGLLFDSKEQDKDFYRKYPTI

YHLRLALMNDDQKHDLREVYLAIHHLVKYRGHFLIEGDVKADSAFDVHTFADAIQRYAESNNSD

ENLLGKIDEKKLSAALTDKHGSKSQRAETAETAFDILDLQSKKQIQAILKSVVGNQANLMAIFG

LDSSAISKDEQKNYKFSFDDADIDEKIADSEALLSDTEFEFLCDLKAAFDGLTLKMLLGDDKTV

SAAMVRRFNEHQKDWEYIKSHIRNAKNAGNGLYEKSKKFDGINAAYLALQSDNEDDRKKAKKIF

QDEISSADIPDDVKADFLKKIDDDQFLPIQRTKNNGTIPHQLHRNELEQIIEKQGIYYPFLKDT

YQENSHELNKITALINFRVPYYVGPLVEEEQKIADDGKNIPDPTNHWMVRKSNDTITPWNLSQV

VDLDKSGRRFIERLTGTDTYLIGEPTLPKNSLLYQKFDVLQELNNIRVSGRRLDIRAKQDAFEH

LFKVQKTVSATNLKDFLVQAGYISEDTQIEGLADVNGKNFNNALTTYNYLVSVLGREFVENPSN

EELLEEITELQTVFEDKKVLRRQLDQLDGLSDHNREKLSRKHYTGWGRISKKLLTTKIVQNADK

IDNQTFDVPRMNQSIIDTLYNTKMNLMEIINNAEDDFGVRAWIDKQNTTDGDEQDVYSLIDELA

GPKEIKRGIVQSFRILDDITKAVGYAPKRVYLEFARKTQESHLTNSRKNQLSTLLKNAGLSELV

TQVSQYDAAALQNDRLYLYFLQQGKDMYSGEKLNLDNLSNYDIDHIIPQAYTKDNSLDNRVLVS

NITNRRKSDSSNYLPALIDKMRPFWSVLSKQGLLSKHKFANLTRTRDFDDMEKERFIARSLVET

RQIIKNVASLIDSHFGGETKAVAIRSSLTADMRRYVDIPKNRDINDYHHAFDALLFSTVGQYTE

NSGLMKKGQLSDSAGNQYNRYIKEWIHAARLNAQSQRVNPFGFVVGSMRNAAPGKLNPETGEIT

PEENADWSIADLDYLHKVMNFRKITVTRRLKDQKGQLYDESRYPSVLHDAKSKASINFDKHKPV

DLYGGFSSAKPAYAALIKFKNKFRLVNVLRQWTYSDKNSEDYILEQIRGKYPKAEMVLSHIPYG

QLVKKDGALVTISSATELHNFEQLWLPLADYKLINTLLKTKEDNLVDILHNRLDLPEMTIESAF

YKAFDSILSFAFNRYALHQNALVKLQAHRDDFNALNYEDKQQTLERILDALHASPASSDLKKIN

LSSGFGRLFSPSHFTLADTDEFIFQSVTGLFSTQKTVAQLYQETK

SEQ ID NO: 313
MVYDVGLDIGTGSVGWVALDENGKLARAKGKNLVGVRLFDTAQTAADRRGFRTTRRRLSRRKWR

LRLLDELFSAEINEIDSSFFQRLKYSYVHPKDEENKAHYYGGYLFPTEEETKKFHRSYPTIYHL

RQELMAQPNKRFDIREIYLAIHHLVKYRGHFLSSQEKITIGSTYNPEDLANAIEVYADEKGLSW

ELNNPEQLTEIISGEAGYGLNKSMKADEALKLFEFDNNQDKVAIKTLLAGLTGNQIDFAKLFGK

DISDKDEAKLWKLKLDDEALEEKSQTILSQLTDEEIELFHAVVQAYDGFVLIGLLNGADSVSAA

MVQLYDQHREDRKLLKSLAQKAGLKHKRFSEIYEQLALATDEATIKNGISTARELVEESNLSKE

VKEDTLRRLDENEFLPKQRTKANSVIPHQLHLAELQKILQNQGQYYPFLLDTFEKEDGQDNKIE

ELLRFRIPYYVGPLVTKKDVEHAGGDADNHWVERNEGFEKSRVTPWNFDKVFNRDKAARDFIER

LTGNDTYLIGEKTLPQNSLRYQLFTVLNELNNVRVNGKKFDSKTKADLINDLFKARKTVSLSAL

KDYLKAQGKGDVTITGLADESKFNSSLSSYNDLKKTFDAEYLENEDNQETLEKIIEIQTVFEDS

KIASRELSKLPLDDDQVKKLSQTHYTGWGRLSEKLLDSKIIDERGQKVSILDKLKSTSQNFMSI

INNDKYGVQAWITEQNTGSSKLTFDEKVNELTTSPANKRGIKQSFAVLNDIKKAMKEEPRRVYL

EFAREDQTSVRSVPRYNQLKEKYQSKSLSEEAKVLKKTLDGNKNKMSDDRYFLYFQQQGKDMYT

GRPINFERLSQDYDIDHIIPQAFTKDDSLDNRVLVSRPENARKSDSFAYTDEVQKQDGSLWTSL

LKSGFINRKKYERLTKAGKYLDGQKTGFIARQLVETRQIIKNVASLIEGEYENSKAVAIRSEIT

ADMRLLVGIKKHREINSFHHAFDALLITAAGQYMQNRYPDRDSTNVYNEFDRYTNDYLKNLRQL

SSRDEVRRLKSFGFVVGTMRKGNEDWSEENTSYLRKVMMFKNILTTKKTEKDRGPLNKETIFSP

```
KSGKKLIPLNSKRSDTALYGGYSNVYSAYMTLVRANGKNLLIKIPISIANQIEVGNLKINDYIV
NNPAIKKFEKILISKLPLGQLVNEDGNLIYLASNEYRHNAKQLWLSTTDADKIASISENSSDEE
LLEAYDILTSENVKNRFPFFKKDIDKLSQVRDEFLDSDKRIAVIQTILRGLQIDAAYQAPVKII
SKKVSDWHKLQQSGGIKLSDNSEMIYQSATGIFETRVKISDLL
```

SEQ ID NO: 314
```
IVDYCIGLDLGTGSVGWAVVDMNHRLMKRNGKHLWGSRLFSNAETAANRRASRSIRRRYNKRRE
RIRLLRAILQDMVLEKDPTFFIRLEHTSFLDEEDKAKYLGTDYKDNYNLFIDEDFNDYTYYHKY
PTIYHLRKALCESTEKADPRLIYLALHHIVKYRGNFLYEGQKFNMDASNIEDKLSDIFTQFTSF
NNIPYEDDEKKNLEILEILKKPLSKKAKVDEVMTLIAPEKDYKSAFKELVTGIAGNKMNVTKMI
LCEPIKQGDSEIKLKFSDSNYDDQFSEVEKDLGEYVEFVDALHNVYSWVELQTIMGATHTDNAS
ISEAMVSRYNKHHDDLKLLKDCIKNNVPNKYFDMFRNDSEKSKGYYNYINRPSKAPVDEFYKYV
KKCIEKVDTPEAKQILNDIELENFLLKQNSRTNGSVPYQMQLDEMIKIIDNQAEYYPILKEKRE
QLLSILTFRIPYYFGPLNETSEHAWIKRLEGKENQRILPWNYQDIVDVDATAEGFIKRMRSYCT
YFPDEEVLPKNSLIVSKYEVYNELNKIRVDDKLLEVDVKNDIYNELFMKNKTVTEKKLKNWLVN
NQCCSKDAEIKGFQKENQFSTSLTPWIDFTNIFGKIDQSNFDLIENIIYDLTVFEDKKIMKRRL
KKKYALPDDKVKQILKLKYKDWSRLSKKLLDGIVADNRFGSSVTVLDVLEMSRLNLMEIINDKD
LGYAQMIEEATSCPEDGKFTYEEVERLAGSPALKRGIWQSLQIVEEITKVMKCRPKYIYIEFER
SEEEAKERTESKIKKLENVYKDLDEQTKKEYKSVLEELKGFDNTKKISSDSLFLYFTQLGKCMYS
GKKLDIDSLDKYQIDHIVPQSLVKDDSFDNRVLVVPSENQRKLDDLVVPFDIRDKMYRFWKLLF
DHELISPKKFYSLIKTEYTERDEERFINRQLVETRQITKNVTQIIEDHYSTTKVAAIRANLSHE
FRVKNHIYKNRDINDYHHAHDAYIVALIGGFMRDRYPNMHDSKAVYSEYMKMFRKNKNDQKRWK
DGFVINSMNYPYEVDGKLIWNPDLINEIKKCFYYKDCYCTTKLDQKSGQLFNLTVLSNDAHADK
GVTKAVVPVNKNRSDVHKYGGFSGLQYTIVAIEGQKKKGKKTELVKKISGVPLHLKAASINEKI
NYIEEKEGLSDVRIIKDNIPVNQMIEMDGGEYLLTSPTEYVNARQLVLNEKQCALIADIYNAIY
KQDYDNLDDILMIQLYIELTNKMKVLYPAYRGIAEKFESMNENYVVISKEEKANIIKQMLIVMH
RGPQNGNIVYDDFKISDRIGRLKTKNHNLNNIVFISQSPTGIYTKKYKL
```

SEQ ID NO: 315
```
MKSEKKYYIGLDVGTNSVGWAVTDEFYNILRAKGKDLWGVRLFEKADTAANTRIFRSGRRRNDR
KGMRLQILREIFEDEIKKVDKDFYDRLDESKFWAEDKKVSGKYSLFNDKNFSDKQYFEKFPTIF
HLRKYLMEEHGKVDIRYYFLAINQMMKRRGHFLIDGQISHVTDDKPLKEQLILLINDLLKIELE
EELMDSIFEILADVNEKRTDKKNNLKELIKGQDFNKQEGNILNSIFESIVTGKAKIKNIISDED
ILEKIKEDNKEDFVLTGDSYEENLQYFEEVLQENITLFNTLKSTYDFLILQSILKGKSTLSDAQ
VERYDEHKKDLEILKKVIKKYDEDGKLFKQVFKEDNGNGYVSYIGYYLNKNKKITAKKKISNIE
FTKYVKGILEKQCDCEDEDVKYLLGKIEQENFLLKQISSINSVIPHQIHLFELDKILENLAKNY
PSFNNKKEEFTKIEKIRKTFTFRIPYYVGPLNDYHKNNGGNAWIFRNGEKIRPWNFEKIVDLH
KSEEEFIKRMLNQCTYLPEETVLPKSSILYSEYMVLNELNNLRINGKPLDTDVKLKLIEELFKK
KTKVTLKSIRDYMVRNNFADKEDFDNSEKNLEIASNMKSYIDFNNILEDKFDVEMVEDLIEKIT
IHTGNKKLLKKYIEETYPDLSSSQIQKIINLKYKDWGRLSRKLLDGIKGTKKETEKTDTVINFL
RNSSDNLMQIIGSQNYSFNEYIDKLRKKYIPQEISYEVVENLYVSPSVKKMIWQVIRVTEEITK
VMGYDPDKIFIEMAKSEEEKKTTISRKNKLLDLYKAIKKDERDSQYEKLLTGLNKLDDSDLRSR
KLYLYYTQMGRDMYTGEKIDLDKLFDSTHYDKDHIIPQSMKKDDSIINNLVLVNKNANQTTKGN
IYPVPSSIRNNPKIYNYWKYLMEKEFISKEKYNRLIRNTPLTNEELGGFINRQLVETRQSTKAI
```

-continued

KELFEKFYQKSKIIPVKASLASDLRKDMNTLKSREVNDLHHAHDAFLNIVAGDVWNREFTSNPI

NYVKENREGDKVKYSLSKDFTRPRKSKGKVIWTPEKGRKLIVDTLNKPSVLISNESHVKKGELF

NATIAGKKDYKKGKIYLPLKKDDRLQDVSKYGGYKAINGAFFFLVEHTKSKKRIRSIELFPLHL

LSKFYEDKNTVLDYAINVLQLQDPKIIIDKINYRTEIIIDNFSYLISTKSNDGSITVKPNEQMY

WRVDEISNLKKIENKYKKDAILTEEDRKIMESYIDKIYQQFKAGKYKNRRTTDTIIEKYEIIDL

DTLDNKQLYQLLVAFISLSYKTSNNAVDFTVIGLGTECGKPRITNLPDNTYLVYKSITGIYEKR

IRIK

SEQ ID NO: 316
MKLRGIEDDYSIGLDMGTSSVGWAVTDERGTLAHFKRKPTWGSRLFREAQTAAVARMPRGQRRR

YVRRRWRLDLLQKLFEQQMEQADPDFFIRLRQSRLLRDDRAEEHADYRWPLFNDCKFTERDYYQ

RFPTIYHVRSWLMETDEQADIRLIYLALHNIVKHRGNFLREGQSLSAKSARPDEALNHLRETLR

VWSSERGFECSIADNGSILAMLTHPDLSPSDRRKKIAPLFDVKSDDAAADKKLGIALAGAVIGL

KTEFKNIFGDFPCEDSSIYLSNDEAVDAVRSACPDDCAELFDRLCEVYSAYVLQGLLSYAPGQT

ISANMVEKYRRYGEDLALLKKLVKIYAPDQYRMFFSGATYPGTGIYDAAQARGYTKYNLGPKKS

EYKPSESMQYDDFRKAVEKLFAKTDARADERYRMMMDRFDKQQFLRRLKTSDNGSIYHQLHLEE

LKAIVENQGRFYPFLKRDADKLVSLVSFRIPYYVGPLSTRNARTDQHGENRFAWSERKPGMQDE

PIFPWNWESIIDRSKSAEKFILRMTGMCTYLQQEPVLPKSSLLYEEFCVLNELNGAHWSIDGDD

EHRFDAADREGIIEELFRRKRTVSYGDVAGWMERERNQIGAHVCGGQGEKGFESKLGSYIFFCK

DVFKVERLEQSDYPMIERIILWNTLFEDRKILSQRLKEEYGSRLSAEQIKTICKKRFTGWGRLS

EKFLTGITVQVDEDSVSIMDVLREGCPVSGKRGRAMVMMEILRDEELGFQKKVDDFNRAFFAEN

AQALGVNELPGSPAVRRSLNQSIRIVDEIASIAGKAPANIFIEVTRDEDPKKKGRRTKRRYNDL

KDALEAFKKEDPELWRELCETAPNDMDERLSLYFMQRGKCLYSGRAIDIHQLSNAGIYEVDHII

PRTYVKDDSLENKALVYREENQRKTDMLLIDPEIRRRMSGYWRMLHEAKLIGDKKFRNLLRSRI

DDKALKGFIARQLVETGQMVKLVRSLLEARYPETNIISVKASISHDLRTAAELVKCREANDFHH

AHDAFLACRVGLFIQKRHPCVYENPIGLSQVVRNYVRQQADIFKRCRTIPGSSGFIVNSFMTSG

FDKETGEIFKDDWDAEAEVEGIRRSLNFRQCFISRMPFEDHGVFWDATIYSPRAKKTAALPLKQ

GLNPSRYGSFSREQFAYFFIYKARNPRKEQTLFEFAQVPVRLSAQIRQDENALERYARELAKDQ

GLEFIRIERSKILKNQLIEIDGDRLCITGKEEVRNACELAFAQDEMRVIRMLVSEKPVSRECVI

SLFNRILLHGDQASRRLSKQLKLALLSEAFSEASDNVQRNVVLGLIAIFNGSTNMVNLSDIGGS

KFAGNVRIKYKKELASPKVNVHLIDQSVTGMFERRTKIGL

SEQ ID NO: 317
MENKQYYIGLDVGTNSVGWAVTDTSYNLLRAKGKDMWGARLFEKANTAAERRTKRTSRRRSERE

KARKAMLKELFADEINRVDPSFFIRLEESKFFLDDRSENNRQRYTLFNDATFTDKDYYEKYKTI

FHLRSALINSDEKFDVRLVFLAILNLFSHRGHFLNASLKGDGDIQGMDVFYNDLVESCEYFEIE

LPRITNIDNFEKILSQKGKSRTKILEELSEELSISKKDKSKYNLIKLISGLEASVVELYNIEDI

QDENKKIKIGFRESDYEESSLKVKEIIGDEYFDLVERAKSVHDMGLLSNIIGNSKYLCEARVEA

YENHHKDLLKIKELLKKYDKKAYNDMFRKMTDKNYSAYVGSVNSNIAKERRSVDKRKIEDLYKY

IEDTALKNIPDDNKDKIEILEKIKLGEFLKKQLTASNGVIPNQLQSRELRAILKKAENYLPFLK

EKGEKNLTVSEMIIQLFEFQIPYYVGPLDKNPKKDNKANSWAKIKQGGRILPWNFEDKVDVKGS

RKEFIEKMVRKCTYISDEHTLPKQSLLYEKFMVLNEINNIKIDGEKISVEAKQKIYNDLFVGKK

KVSQKDIKKELISLNIMDKDSVLSGTDTVCNAYLSSIGKFTGVFKEEINKQSIVDMIEDIIFLK

-continued

TVYGDEKRFVKEEIVEKYGDEIDKDKIKRILGFKFSNWGNLSKSFLELEGADVGTGEVRSIIQS

LWETNFNLMELLSSRFTYMDELEKRVKKLEKPLSEWTIEDLDDMYLSSPVKRMIWQSMKIVDEI

QTVIGYAPKRIFVEMTRSEGEKVRTKSRKDRLKELYNGIKEDSKQWVKELDSKDESYFRSKKMY

LYYLQKGRCMYSGEVIELDKLMDDNLYDIDHIYPRSFVKDDSLDNLVLVKKEINNRKQNDPITP

QIQASCQGFWKILHDQGFMSNEKYSRLTRKTQEFSDEEKLSFINRQIVETGQATKCMAQILQKS

MGEDVDVVFSKARLVSEFRHKFELFKSRLINDFHHANDAYLNIVVGNSYFVKFTRNPANFIKDA

RKNPDNPVYKYHMDRFFERDVKSKSEVAWIGQSEGNSGTIVIVKKTMAKNSPLITKKVEEGHGS

ITKETIVGVKEIKFGRNKVEKADKTPKKPNLQAYRPIKTSDERLCNILRYGGRTSISISGYCLV

EYVKKRKTIRSLEAIPVYLGRKDSLSEEKLLNYFRYNLNDGGKDSVSDIRLCLPFISTNSLVKI

DGYLYYLGGKNDDRIQLYNAYQLKMKKEEVEYIRKIEKAVSMSKFDEIDREKNPVLTEEKNIEL

YNKIQDKFENTVFSKRMSLVKYNKKDLSFGDFLKNKKSKFEEIDLEKQCKVLYNIIFNLSNLKE

VDLSDIGGSKSTGKCRCKKNITNYKEFKLIQQSITGLYSCEKDLMTI

SEQ ID NO: 318

MKNLKEYYIGLDIGTASVGWAVTDESYNIPKFNGKKMWGVRLFDDAKTAEERRTQRGSRRRLNR

RKERINLLQDLFATEISKVDPNFFLRLDNSDLYREDKDEKLKSKYTLFNDKDFKDRDYHKKYPT

IHHLIMDLIEDEGKKDIRLLYLACHYLLKNRGHFIFEGQKFDTKNSFDKSINDLKIHLRDEYNI

DLEFNNEDLIEIITDTTLNKTNKKKELKNIVGDTKFLKAISAIMIGSSQKLVDLFEDGEFEETT

VKSVDFSTTAFDDKYSEYEEALGDTISLLNILKSIYDSSILENLLKDADKSKDGNKYISKAFVK

KFNKHGKDLKTLKRIIKKYLPSEYANIFRNKSINDNYVAYTKSNITSNKRTKASKFTKQEDFYK

FIKKHLDTIKETKLNSSENEDLKLIDEMLTDIEFKTFIPKLKSSDNGVIPYQLKLMELKKILDN

QSKYYDFLNESDEYGTVKDKVESIMEFRIPYYVGPLNPDSKYAWIKRENTKITPWNFKDIVDLD

SSREEFIDRLIGRCTYLKEEKVLPKASLIYNEFMVLNELNNLKLNEFLITEEMKKAIFEELFKT

KKKVTLKAVSNLLKKEFNLTGDILLSGTDGDFKQGLNSYIDFKNIIGDKVDRDDYRIKIEEIIK

LIVLYEDDKTYLKKKIKSAYKNDFTDDEIKKIAALNYKDWGRLSKRFLTGIEGVDKTTGEKGSI

IYFMREYNLNLMELMSGHYTFTEEVEKLNPVENRELCYEMVDELYLSPSVKRMLWQSLRVVDEI

KRIIGKDPKKIFIEMARAKEAKNSRKESRKNKLLEFYKFGKKAFINEIGEERYNYLLNEINSEE

ESKFRWDNLYLYYTQLGRCMYSLEPIDLADLKSNNIYDQDHIYPKSKIYDDSLENRVLVKKNLN

HEKGNQYPIPEKVLNKNAYGFWKILFDKGLIGQKKYTRLTRRTPFEERELAEFIERQIVETRQA

TKETANLLKNICQDSEIVYSKAENASRFRQEFDIIKCRTVNDLHHMHDAYLNIVVGNVYNTKFT

KNPLNFIKDKDNVRSYNLENMFKYDVVRGSYTAWIADDSEGNVKAATIKKVRELEGKNYRFTR

MSYIGTGGLYDQNLMRKGKGQIPQKENTNKSNIEKYGGYNKASSAYFALIESDGKAGRERTLET

IPIMVYNQEKYGNTEAVDKYLKDNLELQDPKILKDKIKINSLIKLDGFLYNIKGKTGDSLSIAG

SVQLIVNKEEQKLIKKMDKFLVKKKDNKDIKVTSFDNIKEEELIKLYKTLSDKLNNGIYSNKRN

NQAKNISEALDKFKEISIEEKIDVLNQIILLFQSYNNGCNLKSIGLSAKTGVVFIPKKLNYKEC

KLINQSITGLFENEVDLLNL

SEQ ID NO: 319

MGKMYYLGLDIGTNSVGYAVTDPSYHLLKFKGEPMWGAHVFAAGNQSAERRSFRTSRRRLDRRQ

QRVKLVQEIFAPVISPIDPRFFIRLHESALWRDDVAETDKHIFFNDPTYTDKEYYSDYPTIHHL

IVDLMESSEKHDPRLVYLAVAWLVAHRGHFLNEVDKDNIGDVLSFDAFYPEFLAFLSDNGVSPW

VCESKALQATLLSRNSVNDKYKALKSLIFGSQKPEDNFDANISEDGLIQLLAGKKVKVNKLFPQ

ESNDASFTLNDKEDAIEEILGTLTPDECEWIAHIRRLFDWAIMKHALKDGRTISESKVKLYEQH

HHDLTQLKYFVKTYLAKEYDDIFRNVDSETTKNYVAYSYHVKEVKGTLPKNKATQEEFCKYVLG

-continued

KVKNIECSEADKVDFDEMIQRLTDNSFMPKQVSGENRVIPYQLYYYELKTILNKAASYLPFLTQ

CGKDAISNQDKLLSIMTFRIPYFVGPLRKDNSEHAWLERKAGKIYPWNFNDKVDLDKSEEAFIR

RMTNTCTYYPGEDVLPLDSLIYEKFMILNEINNIRIDGYPISVDVKQQVFGLFEKKRRVTVKDI

QNLLLSLGALDKHGKLTGIDTTIHSNYNTYHHFKSLMERGVLTRDDVERIVERMTYSDDTKRVR

LWLNNNYGTLTADDVKHISRLRKHDFGRLSKMFLTGLKGVHKETGERASILDFMWNTNDNLMQL

LSECYTFSDEITKLQEAYYAKAQLSLNDFLDSMYISNAVKRPIYRTLAVVNDIRKACGTAPKRI

FIEMARDGESKKKRSVTRREQIKNLYRSIRKDFQQEVDFLEKILENKSDGQLQSDALYLYFAQL

GRDMYTGDPIKLEHIKDQSFYNIDHIYPQSMVKDDSLDNKVLVQSEINGEKSSRYPLDAAIRNK

MKPLWDAYYNHGLISLKKYQRLTRSTPFTDDEKWDFINRQLVETRQSTKALAILLKRKFPDTEI

VYSKAGLSSDFRHEFGLVKSRNINDLHHAKDAFLAIVTGNVYHERFNRRWFMVNQPYSVKTKTL

FTHSIKNGNFVAWNGEEDLGRIVKMLKQNKNTIHFTRFSFDRKEGLFDIQPLKASTGLVPRKAG

LDVVKYGGYDKSTAAYYLLVRFTLEDKKTQHKLMMIPVEGLYKARIDHDKEFLTDYAQTTISEI

LQKDKQKVINIMFPMGTRHIKLNSMISIDGFYLSIGGKSSKGKSVLCHAMVPLIVPHKIECYIK

AMESFARKFKENNKLRIVEKFDKITVEDNLNLYELFLQKLQHNPYNKFFSTQFDVLTNGRSTFT

KLSPEEQVQTLLNILSIFKTCRSSGCDLKSINGSAQAARIMISADLTGLSKKYSDIRLVEQSAS

GLFVSKSQNLLEYL

SEQ ID NO: 320
MTKKEQPYNIGLDIGTSSVGWAVTNDNYDLLNIKKKNLWGVRLFEEAQTAKETRLNRSTRRRYR

RRKNRINWLNEIFSEELAKTDPSFLIRLQNSWVSKKDPDRKRDKYNLFIDGPYTDKEYYREFPT

IFHLRKELILNKDKADIRLIYLALHNILKYRGNFTYEHQKFNISNLNNNLSKELIELNQQLIKY

DISFPDDCDWNHISDILIGRGNATQKSSNILKDFTLDKETKKLLKEVINLILGNVAHLNTIFKT

SLTKDEEKLNFSGKDIESKLDDLDSILDDDQFTVLDAANRIYSTITLNEILNGESYFSMAKVNQ

YENHAIDLCKLRDMWHTTKNEEAVEQSRQAYDDYINKPKYGTKELYTSLKKFLKVALPTNLAKE

AEEKISKGTYLVKPRNSENGVVPYQLNKIEMEKIIDNQSQYYPFLKENKEKLLSILSFRIPYYV

GPLQSAEKNPFAWMERKSNGHARPWNFDEIVDREKSSNKFIRRMTVTDSYLVGEPVLPKNSLIY

QRYEVLNELNNIRITENLKTNPIGSRLTVETKQRIYNELFKKYKKVTVKKLTKWLIAQGYYKNP

ILIGLSQKDEFNSTLTTYLDMKKIFGSSFMEDNKNYDQIEELIEWLTIFEDKQILNEKLHSSKY

SYTPDQIKKISNMRYKGWGRLSKKILMDITTETNTPQLLQLSNYSILDLMWATNNNFISIMSND

KYDFKNYIENHNLNKNEDQNISDLVNDIHVSPALKRGITQSIKIVQEIVKFMGHAPKHIFIEVT

RETKKSEITTSREKRIKRLQSKLLNKANDFKPQLREYLVPNKKIQEELKKHKNDLSSERIMLYF

LQNGKSLYSEESLNINKLSDYQVDHILPRTYIPDDSLENKALVLAKENQRKADDLLLNSNVIDR

NLERWTYMLNNNMIGLKKFKNLTRRVITDKDKLGFIHRQLVQTSQMVKGVANILDNMYKNQGTT

CIQARANLSTAFRKALSGQDDTYHFKHPELVKNRNVNDFHHAQDAYLASFLGTYRLRRFPTNEM

LLMNGEYNKFYGQVKELYSKKKKLPDSRKNGFIISPLVNGTTQYDRNTGEIIWNVGFRDKILKI

FNYHQCNVTRKTEIKTGQFYDQTIYSPKNPKYKKLIAQKKDMDPNIYGGFSGDNKSSITIVKID

NNKIKPVAIPIRLINDLKDKKTLQNWLEENVKHKKSIQIIKNNVPIGQIIYSKKVGLLSLNSDR

EVANRQQLILPPEHSALLRLLQIPDEDLDQILAFYDKNILVEILQELITKMKKFYPFYKGEREF

LIANIENFNQATTSEKVNSLEELITLLHANSTSAHLIFNNIEKKAFGRKTHGLTLNNTDFIYQS

VTGLYETRIHIE

SEQ ID NO: 321

MTKFNKNYSIGLDIGVSSVGYAVVTEDYRVPAFKFKVLGNTEKEKIKKNLIGSTTFVSAQPAKG
TRVFRVNRRRIDRRNHRITYLRDIFQKEIEKVDKNFYRRLDESFRVLGDKSEDLQIKQPFFGDK
ELETAYHKKYPTIYHLRKHLADADKNSPVADIREVYMAISHILKYRGHFLTLDKINPNNINMQN
SWIDFIESCQEVFDLEISDESKNIADIFKSSENRQEKVKKILPYFQQELLKKDKSIFKQLLQLL
FGLKTKFKDCFELEEEPDLNFSKENYDENLENFLGSLEEDFSDVFAKLKVLRDTILLSGMLTYT
GATHARFSATMVERYEEHRKDLQRFKFFIKQNLSEQDYLDIFGRKTQNGFDVDKETKGYVGYIT
NKMVLTNPQKQKTIQQNFYDYISGKITGIEGAEYFLNKISDGTFLRKLRTSDNGAIPNQIHAYE
LEKIIERQGKDYPFLLENKDKLLSILTFKIPYYVGPLAKGSNSRFAWIKRATSSDILDDNDEDT
RNGKIRPWNYQKLINMDETRDAFITNLIGNDIILLNEKVLPKRSLIYEEVMLQNELTRVKYKDK
YGKAHFFDSELRQNIINGLFKNNSKRVNAKSLIKYLSDNHKDLNAIEIVSGVEKGKSFNSTLKT
YNDLKTIFSEELLDSEIYQKELEEIIKVITVFDDKKSIKNYLTKFFGHLEILDEEKINQLSKLR
YSGWGRYSAKLLLDIRDEDTGFNLLQFLRNDEENRNLTKLISDNTLSFEPKIKDIQSKSTIEDD
IFDEIKKLAGSPAIKRGILNSIKIVDELVQIIGYPPHNIVIEMARENMTTEEGQKKAKTRKTKL
ESALKNIENSLLENGKVPHSDEQLQSEKLYLYYLQNGKDMYTLDKTGSPAPLYLDQLDQYEVDH
IIPYSFLPIDSIDNKVLTHRENNQQKLNNIPDKETVANMKPFWEKLYNAKLISQTKYQRLTTSE
RTPDGVLTESMKAGFIERQLVETRQIIKHVARILDNRFSDTKIITLKSQLITNFRNTFHIAKIR
ELNDYHHAHDAYLAVVVGQTLLKVYPKLAPELIYGHHAHFNRHEENKATLRKHLYSNIMRFFNN
PDSKVSKDIWDCNRDLPIIKDVIYNSQINFVKRTMIKKGAFYNQNPVGKFNKQLAANNRYPLKT
KALCLDTSIYGGYGPMNSALSIIIIAERFNEKKGKIETVKEFHDIFIIDYEKFNNNPFQFLNDT
SENGFLKKNNINRVLGFYRIPKYSLMQKIDGTRMLFESKSNLHKATQFKLTKTQNELFFHMKRL
LTKSNLMDLKSKSAIKESQNFILKHKEEFDNISNQLSAFSQKMLGNTTSLKNLIKGYNERKIKE
IDIRDETIKYFYDNFIKMFSFVKSGAPKDINDFFDNKCTVARMRPKPDKKLLNATLIHQSITGL
YETRIDLSKLGED

SEQ ID NO: 322

MKQEYFLGLDMGTGSLGWAVTDSTYQVMRKHGKALWGTRLFESASTAEERRMFRTARRRLDRRN
WRIQVLQEIFSEEISKVDPGFFLRMKESKYYPEDKRDAEGNCPELPYALFVDDNYTDKNYHKDY
PTIYHLRKMLETTEIPDIRLVYLVLHHMMKHRGHFLLSGDISQIKEFKSTFEQLIQNIQDEEL
EWHISLDDAAIQFVEHVLKDRNLTRSTKKSRLIKQLNAKSACEKAILNLLSGGTVKLSDIFNNK
ELDESERPKVSFADSGYDDYIGIVEAELAEQYYIIASAKAVYDWSVLVEILGNSVSISEAKIKV
YQKHQADLKTLKKIVRQYMTKEDYKRVFVDTEEKLNNYSAYIGMTKKNGKKVDLKSKQCTQADF
YDFLKKNVIKVIDHKEITQEIESEIEKENFLPKQVTKDNGVIPYQVHDYELKKILDNLGTRMPF
IKENAEKIQQLFEFRIPYYVGPLNRVDDGKDGKFTWSVRKSDARIYPWNFTEVIDVEASAEKFI
RRMTNKCTYLVGEDVLPKDSLVYSKFMVLNELNNLRLNGEKISVELKQRIYEELFCKYRKVTRK
KLERYLVIEGIAKKGVEITGIDGDFKASLTAYHDFKERLTDVQLSQRAKEAIVLNVVLFGDDKK
LLKQRLSKMYPNLTTGQLKGICSLSYQGWGRLSKTFLEEITVPAPGTGEVWNIMTALWQTNDNL
MQLLSRNYGFTNEVEEFNTLKKETDLSYKTVDELYVSPAVKRQIWQTLKVVKEIQKVMGNAPKR
VFVEMAREKQEGKRSDSRKKQLVELYRACKNEERDWITELNAQSDQQLRSDKLFLYYIQKGRCM
YSGETIQLDELWDNTKYDIDHIYPQSKTMDDSLNNRVLVKKNYNAIKSDTYPLSLDIQKKMMSF
WKMLQQQGFITKEKYVRLVRSDELSADELAGFIERQIVETRQSTKAVATILKEALPDTEIVYVK
AGNVSNFRQTYELLKVREMNDLHHAKDAYLNIVVGNAYFVKFTKNAAWFIRNNPGRSYNLKRMF

-continued

EFDIERSGEIAWKAGNKGSIVTVKKVMQKNNILVTRKAYEVKGGLFDQQIMKKGKGQVPIKGND
ERLADIEKYGGYNKAAGTYFMLVKSLDKKGKEIRTIEFVPLYLKNQIEINHESAIQYLAQERGL
NSPEILLSKIKIDTLFKVDGFKMWLSGRTGNQLIFKGANQLILSHQEAAILKGVVKYVNRKNEN
KDAKLSERDGMTEEKLLQLYDTFLDKLSNTVYSIRLSAQIKTLTEKRAKFIGLSNEDQCIVLNE
ILHMFQCQSGSANLKLIGGPGSAGILVMNNNITACKQISVINQSPTGIYEKEIDLIKL

SEQ ID NO: 323
MKKPYSIGLDIGTNSVGWAVVTDDYKVPAKKMKVLGNTDKSHIEKNLLGALLFDSGNTAEDRRL
KRTARRRYTRRRNRILYLQEIFSEEMGKVDDSFFHRLEDSFLVTEDKRGERHPIFGNLEEEVKY
HENFPTIYHLRQYLADNPEKVDLRLVYLALAHIIKFRGHFLIEGKFDTRNNDVQRLFQEFLAVY
DNTFENSSLQEQNVQVEEILTDKISKSAKKDRVLKLFPNEKSNGRFAEFLKLIVGNQADFKKHF
ELEEKAPLQFSKDTYEEELEVLLAQIGDNYAELFLSAKKLYDSILLSGILTVTDVGTKAPLSAS
MIQRYNEHQMDLAQLKQFIRQKLSDKYNEVFSDVSKDGYAGYIDGKTNQEAFYKYLKGLLNKIE
GSGYFLDKIEREDFLRKQRTFDNGSIPHQIHLQEMRAIIRRQAEFYPFLADNQDRIEKLLTFRI
PYYVGPLARGKSDFAWLSRKSADKITPWNFDEIVDKESSAEAFINRMTNYDLYLPNQKVLPKHS
LLYEKFTVYNELTKVKYKTEQGKTAFFDANMKQEIFDGVFKVYRKVTKDKLMDFLEKEFDEFRI
VDLTGLDKENKVFNASYGTYHDLCKILDKDFLDNSKNEKILEDIVLTLTLFEDREMIRKRLENY
SDLLTKEQVKKLERRHYTGWGRLSAELIHGIRNKESRKTILDYLIDDGNSNRNFMQLINDDALS
FKEEIAKAQVIGETDNLNQVVSDIAGSPAIKKGILQSLKIVDELVKIMGHQPENIVVEMARENQ
FTNQGRRNSQQRLKGLTDSIKEFGSQILKEHPVENSQLQNDRLFLYYLQNGRDMYTGEELDIDY
LSQYDIDHIIPQAFIKDNSIDNRVLTSSKENRGKSDDVPSKDVVRKMKSYWSKLLSAKLITQRK
FDNLTKAERGGLTDDDKAGFIKRQLVETRQITKHVARILDERFNTETEDENNKKIRQVKIVTLKS
NLVSNFRKEFELYKVREINDYHHAHDAYLNAVIGKALLGVYPQLEPEFVYGDYPHFHGHKENKA
TAKKFFYSNIMNFFKKDDVRTDKNGEIIWKKDEHISNIKKVLSYPQVNIVKKVEEQTGGFSKES
ILPKGNSDKLIPRKTKKFYWDTKKYGGFDSPIVAYSILVIADIEKGKSKKLKTVKALVGVTIME
KMTFERDPVAFLERKGYRNVQEENIIKLPKYSLFKLENGRKRLLASARELQKGNEIVLPNHLGT
LLYHAKNIHKVDEPKHLDYVDKHKDEFKELLDVVSNFSKKYTLAEGNLEKIKELYAQNNGEDLK
ELASSFINLLTFTAIGAPATFKFFDKNIDRKRYTSTTEILNATLIHQSITGLYETRIDLNKLGG
D

SEQ ID NO: 7
MDKKYSIGLDIGTNSVGWAVITDEYKVPSKKFKVLGNTDRHSIKKNLIGALLFDSGETAEATRL
KRTARRRYTRRKNRICYLQEIFSNEMAKVDDSFFHRLEESFLVEEDKKHERHPIFGNIVDEVAY
HEKYPTIYHLRKKLVDSTDKADLRLIYLALAHMIKFRGHFLIEGDLNPDNSDVDKLFIQLVQTY
NQLFEENPINASGVDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILRVNTEITKAPLSAS
MIKRYDEHHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKILTFRI
PYYVGPLARGNSRFAWMTRKSEETITPWNFEEVVDKGASAQSFIERMTNFDKNLPNEKVLPKHS
LLYEYFTVYNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERLKTYA
HLFDDKVMKQLKRRRYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRHKPENIVIEMARENQ
TTQKGQKNSRERMKRIEEGIKELGSQILKEHPVENTQLQNEKLYLYYLQNGRDMYVDQELDINR

-continued

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD

SEQ ID NO: 325
MTKPYSIGLDIGTNSVGWAVTTDNYKVPSKKMKVLGNTSKKYIKKNLLGVLLFDSGITAEGRRL

KRTARRRYTRRRNRILYLQEIFSTEMATLDDAFFQRLDDSFLVPDDKRDSKYPIFGNLVEEKAY

HDEFPTIYHLRKYLADSTKKADLRLVYLALAHMIKYRGHFLIEGEFNSKNNDIQKNFQDFLDTY

NAIFESDLSLENSKQLEEIVKDKISKLEKKDRILKLFPGEKNSGIFSEFLKLIVGNQADFRKCF

NLDEKASLHFSKESYDEDLETLLGYIGDDYSDVFLKAKKLYDAILLSGFLTVTDNETEAPLSSA

MIKRYNEHKEDLALLKEYIRNISLKTYNEVFKDDTKNGYAGYIDGKTNQEDFYVYLKKLLAEFE

GADYFLEKIDREDFLRKQRTFDNGSIPYQIHLQEMRAILDKQAKFYPFLAKNKERIEKILTFRI

PYYVGPLARGNSDFAWSIRKRNEKITPWNFEDVIDKESSAEAFINRMTSFDLYLPEEKVLPKHS

LLYETFNVYNELTKVRFIAESMRDYQFLDSKQKKDIVRLYFKDKRKVTDKDIIEYLHAIYGYDG

IELKGIEKQFNSSLSTYHDLLNIINDKEFLDDSSNEAIIEEIIHTLTIFEDREMIKQRLSKFEN

IFDKSVLKKLSRRHYTGWGKLSAKLINGIRDEKSGNTILDYLIDDGISNRNFMQLIHDDALSFK

KKIQKAQIIGDEDKGNIKEVVKSLPGSPAIKKGILQSIKIVDELVKVMGGRKPESIVVEMAREN

QYTNQGKSNSQQRLKRLEKSLKELGSKILKENIPAKLSKIDNNALQNDRLYLYYLQNGKDMYTG

DDLDIDRLSNYDIDHIIPQAFLKDNSIDNKVLVSSASNRGKSDDVPSLEVVKKRKTFWYQLLKS

KLISQRKFDNLTKAERGGLSPEDKAGFIQRQLVETRQITKHVARLLDEKFNNKKDENNRAVRTV

KIITLKSTLVSQFRKDFELYKVREINDFHHAHDAYLNAVVASALLKKYPKLEPEFVYGDYPKYN

SFRERKSATEKVYFYSNIMNIFKKSISLADGRVIERPLIEVNEETGESVWNKESDLATVRRVLS

YPQVNVVKKVEEQNHGLDRGKPKGLFNANLSSKPKPNSNENLVGAKEYLDPKKYGGYAGISNSF

TVLVKGTIEKGAKKKITNVLEFQGISILDRINYRKDKLNFLLEKGYKDIELIIELPKYSLFELS

DGSRRMLASILSTNNKRGEIHKGNQIFLSQKFVKLLYHAKRISNTINENHRKYVENHKKEFEEL

FYYILEFNENYVGAKKNGKLLNSAFQSWQNHSIDELCSSFIGPTGSERKGLFELTSRGSAADFE

FLGVKIPRYRDYTPSSLLKDATLIHQSVTGLYETRIDLAKLGEG

SEQ ID NO: 326
MKKQKFSDYYLGFDIGTNSVGWCVTDLDYNVLRFNKKDMWGSRLFDEAKTAAERRVQRNSRRRL

KRRKWRLNLLEEIFSDEIMKIDSNFFRRLKESSLWLEDKNSKEKFTLFNDDNYKDYDFYKQYPT

IFHLRDELIKNPEKKDIRLIYLALHSIFKSRGHFLFEGQNLKEIKNFETLYNNLISFLEDNGIN

KSIDKDNIEKLEKIICDSGKGLKDKEKEFKGIFNSDKQLVAIFKLSVGSSVSLNDLFDTDEYKK

EEVEKEKISFREQIYEDDKPIYYSILGEKIELLDIAKSFYDFMVLNNILSDSNYISEAKVKLYE

EHKKDLKNLKYIIRKYNKENYDKLFKDKNENNYPAYIGLNKEKDKKEVVEKSRLKIDDLIKVTK

GYLPKPERIEEKDKTIFNEILNKIELKTILPKQRISDNGTLPYQIHEVELEKILENQSKYYDFL

NYEENGVSTKDKLLKTFKFRIPYYVGPLNSYHKDKGGNSWIVRKEEGKILPWNFEQKVDIEKSA

```
EEFIKRMTNKCTYLNGEDVIPKDSFLYSEYIILNELNKVQVNDEFLNEENKRKIIDELFKENKK
VSEKKKFKEYLLVNQIANRTVELKGIKDSFNSNYVSYIKFKDIFGEKLNLDIYKEISEKSILWKC
LYGDDKKIFEKKIKNEYGDILNKDEIKKINSFKFNTWGRLSEKLLTGIEFINLETGECYSSVME
ALRRTNYNLMELLSSKFTLQESIDNENKEMNEVSYRDLIEESYVSPSLKRAILQTLKIYEEIKK
ITGRVPKKVFIEMARGGDESMKNKKIPARQEQLKKLYDSCGNDIANFSIDIKEMKNSLSSYDNN
SLRQKKLYLYYLQFGKCMYTGREIDLDRLLQNNDTYDIDHIYPRSKVIKDDSFDNLVLVLKNEN
AEKSNEYPVKKEIQEKMKSFWRFLKEKNFISDEKYKRLTGKDDFELRGFMARQLVNVRQTTKEV
GKILQQIEPEIKIVYSKAEIASSFREMFDFIKVRELNDTHHAKDAYLNIVAGNVYNTKFTEKPY
RYLQEIKENYDVKKIYNYDIKNAWDKENSLEIVKKNMEKNTVNITRFIKEEKGELFNLNPIKKG
ETSNEIISIKPKLYDGKDNKLNEKYGYYTSLKAAYFIYVEHEKKNKKVKTFERITRIDSTLIKN
EKNLIKYLVSQKKLLNPKIIKKIYKEQTLIIDSYPYTFTGVDSNKKVELKNKKQLYLEKKYEQI
LKNALKFVEDNQGETEENYKFIYLKKRNNNEKNETIDAVKERYNIEFNEMYDKFLEKLSSKDYK
NYIINNKLYTNFLNSKEKFKKLKLWEKSLILREFLKIFNKNTYGKYEIKDSQTKEKLFSFPEDTG
RIRLGQSSLGNNKELLEESVTGLFVKKIKL
```

SEQ ID NO: 327
```
MKNYTIGLDIGVASVGWVCIDENYKILNYNNRHAFGVHEFESAESAAGRRLKRGMRRRYNRRKK
RLQLLQSLFDSYITDSGFFSKTDSQHFWKNNNEFENRSLTEVLSSLRISSRKYPTIYHLRSDLI
ESNKKMDLRLVYLALHNLVKYRGHFLQEGNWSEAASAEGMDDQLLELVTRYAELENLSPLDLSE
SQWKAAETLLLNRNLTKTDQSKELTAMFGKEYEPFCKLVAGLGVSLHQLFPSSEQALAYKETKT
KVQLSNENVEEVMELLLEEESALLEAVQPFYQQVVLYELLKGETYVAKAKVSAFKQYQKDMASL
KNLLDKTFGEKVYRSYFISDKNSQREYQKSHKVEVLCKLDQFNKEAKFAETFYKDLKKLLEDKS
KTSIGTTEKDEMLRIIKAIDSNQFLQKQKGIQNAAIPHQNSLYEAEKILRNQQAHYPFITTEWI
EKVKQILAFRIPYYIGPLVKDTTQSPFSWVERKGDAPITPWNFDEQIDKAASAEAFISRMRKTC
TYLKGQEVLPKSSLTYERFEVLNELNGIQLRTTGAESDFRHRLSYEMKCWIIDNVFKQYKTVST
KRLLQELKKSPYADELYDEHTGEIKEVFGTQKENAFATSLSGYISMKSILGAVVDDNPAMTEEL
IYWIAVFEDREILHLKIQEKYPSITDVQRQKLALVKLPGWGRFSRLLIDGLPLDEQGQSVLDHM
EQYSSVFMEVLKNKGFGLEKKIQKMNQHQVDGTKKIRYEDIEELAGSPALKRGIWRSVKIVEEL
VSIFGEPANIVLEVAREDGEKKRTKSRKDQWEELTKTTLKNDPDLKSFIGEIKSQGDQRFNEQR
FWLYVTQQGKCLYTGKALDIQNLSMYEVDHILPQNFVKDDSLDNLALVMPEANQRKNQVGQNKM
PLEIIEANQQYAMRTLWERLHELKLISSGKLGRLKKPSFDEVDKDKFIARQLVETRQIIKHVRD
LLDERFSKSDIHLVKAGIVSKFRRFSEIPKIRDYNNKHHAMDALFAAALIQSILGKYGKNFLAF
DLSKKDRQKQWRSVKGSNKEFFLFKNFGNLRLQSPVTGEEVSGVEYMKHVYFELPWQTTKMTQT
GDGMFYKESIFSPKVKQAKYVSPKTEKFVHDEVKNHSICLVEFTFMKKEKEVQETKFIDLKVIE
HHQFLKEPESQLAKFLAEKETNSPIIHARIIRTIPKYQKIWIEHFPYYFISTRELHNARQFEIS
YELMEKVKQLSERSSVEELKIVFGLLIDQMNDNYPIYTKSSIQDRVQKFVDTQLYDFKSFEIGF
EELKKAVAANAQRSDTFGSRISKKPKPEEVAIGYESITGLKYRKPRSVVGTKR
```

SEQ ID NO: 328
```
MKKEIKDYFLGLDVGTGSVGWAVTDTDYKLLKANRKDLWGMRCFETAETAEVRRLHRGARRRIE
RRKKKRIKLLQELFSQEIAKTDEGFFQRMKESPFYAEDKTILQENTLFNDKDFADKTYHKAYPTI
NHLIKAWIENKVKPDPRLLYLACHNIIKKRGHFLFEGDFDSENQFDTSIQALFEYLREDMEVDI
DADSQKVKEILKDSSLKNSEKQSRLNKILGLKPSDKQKKAITNLISGNKINFADLYDNPDLKDA
EKNSISFSKDDFDALSDDLASILGDSFELLLKAKAVYNCSVLSKVIGDEQYLSFAKVKIYEKHK
```

-continued

```
TDLTKLKNVIKKHFPKDYKKVFGYNKNEKNNNNYSGYVGVCKTKSKKLIINNSVNQEDFYKFLK

TILSAKSEIKEVNDILTEIETGTFLPKQISKSNAEIPYQLRKMELEKILSNAEKHFSFLKQKDE

KGLSHSEKIIMLLTFKIPYYIGPINDNHKKFFPDRCWVVKKEKSPSGKTTPWNFFDHIDKEKTA

EAFITSRTNFCTYLVGESVLPKSSLLYSEYTVLNEINNLQIIIDGKNICDIKLKQKIYEDLFKK

YKKITQKQISTFIKHEGICNKTDEVIILGIDKECTSSLKSYIELKNIFGKQVDEISTKNMLEEI

IRWATIYDEGEGKTILKTKIKAEYGKYCSDEQIKKILNLKFSGWGRLSRKFLETVTSEMPGFSE

PVNIITAMRETQNNLMELLSSEFTFTENIKKINSGFEDAEKQFSYDGLVKPLFLSPSVKKMLWQ

TLKLVKEISHITQAPPKKIFIEMAKGAELEPARTKTRLKILQDLYNNCKNDADAFSSEIKDLSG

KIENEDNLRLRSDKLYLYYTQLGKCMYCGKPIEIGHVFDTSNYDIDHIYPQSKIKDDSISNRVL

VCSSCNKNKEDKYPLKSEIQSKQRGFWNFLQRNNFISLEKLNRLTRATPISDDETAKFIARQLV

ETRQATKVAAKVLEKMFPETKIVYSKAETVSMFRNKFDIVKCREINDFHHAHDAYLNIVVGNVY

NTKFTNNPWNFIKEKRDNPKIADTYNYYKVFDYDVKRNNITAWEKGKTIITVKDMLKRNTPIYT

RQAACKKGELFNQTIMKKGLGQHPLKKEGPFSNISKYGGYNKVSAAYYTLIEYEEKGNKIRSLE

TIPLYLVKDIQKDQDVLKSYLTDLLGKKEFKILVPKIKINSLLKINGFPCHITGKTNDSFLLRP

AVQFCCSNNEVLYFKKIIRFSEIRSQREKIGKTISPYEDLSFRSYIKENLWKKTKNDEIGEKEF

YDLLQKKNLEIYDMLLTKHKDTIYKKRPNSATIDILVKGKEKFKSLIIENQFEVILEILKLFSA

TRNVSDLQHIGGSKYSGVAKIGNKISSLDNCILIYQSITGIFEKRIDLLKV

SEQ ID NO: 329
MEGQMKNNGNNLQQGNYYLGLDVGTSSVGWAVTDTDYNVLKFRGKSMWGARLFDEASTAEERRT

HRGNRRRLARRKYRLLLLEQLFEKEIRKIDDNFFVRLHESNLWADDKSKPSKFLLFNDTNFTDK

DYLKKYPTIYHLRSDLIHNSTEHDIRLVFLALHHLIKYRGHFIYDNSANGDVKTLDEAVSDFEE

YLNENDIEFNIENKKEFINVLSDKHLTKKEKKISLKKLYGDITDSENINISVLIEMLSGSSISL

SNLFKDIEFDGKQNLSLDSDIEETLNDVVDILGDNIDLLIHAKEVYDIAVLTSSLGKHKYLCDA

KVELFEKNKKDLMILKKYIKKNHPEDYKKIFSSPTEKKNYAAYSQTNSKNVCSQEEFCLFIKPY

IRDMVKSENEDEVRIAKEVEDKSFLTKLKGTNNSVVPYQIHERELNQILKNIVAYLPFMNDEQE

DISVVDKIKLIFKFKIPYYVGPLNTKSTRSWVYRSDEKIYPWNFSNVIDLDKTAHEFMNRLIGR

CTYTNDPVLPMDSLLYSKYNVLNEINPIKVNGKAIPVEVKQAIYTDLFENSKKKVTRKSIYIYL

LKNGYIEKEDIVSGIDIEIKSKLKSHHDFTQIVQENKCTPEEIERIIKGILVYSDDKSMLRRWL

KNNIKGLSENDVKYLAKLNYKEWGRLSKTLLTDIYTINPEDGEACSILDIMWNTNATLMEILSN

EKYQFKQNIENYKAENYDEKQNLHEELDDMYISPAARRSIWQALRIVDEIVDIKKSAPKKIFIE

MAREKKSAMKKKRTESRKDTLLELYKSCKSQADGFYDEELFEKLSNESNSRLRRDQLYLYYTQM

GRSMYTGKRIDFDKLINDKNTYDIDHIYPRSKIKDDSITNRVLVEKDINGEKTDIYPISEDIRQ

KMQPFWKILKEKGLINEEKYKRLTRNYELTDEELSSFVARQLVETQQSTKALATLLKKEYPSAK

IVYSKAGNVSEFRNRKDKELPKFREINDLHHAKDAYLNIVVGNVYDTKFTEKFFNNIRNENYSL

KRVFDFSVPGAWDAKGSTFNTIKKYMAKNNPIIAFAPYEVKGELFDQQIVPKGKGQFPIKQGKD

IEKYGGYNKLSSAFLFAVEYKGKKARERSLETVYIKDVELYLQDPIKYCESVLGLKEPQIIKPK

ILMGSLFSINNKKLVVTGRSGKQYVCHHIYQLSINDEDSQYLKNIAKYLQEEPDGNIERQNILN

ITSVNNIKLFDVLCTKFNSNTYEIILNSLKNDVNEGREKFSELDILEQCNILLQLLKAFKCNRE

SSNLEKLNNKKQAGVIVIPHLFTKCSVFKVIHQSITGLFEKEMDLLK
```

-continued

SEQ ID NO: 330
MGRKPYILSLDIGTGSVGYACMDKGFNVLKYHDKDALGVYLFDGALTAQERRQFRTSRRRKNRR
IKRLGLLQELLAPLVQNPNFYQFQRQFAWKNDNMDFKNKSLSEVLSFLGYESKKYPTIYHLQEA
LLLKDEKFDPELIYMALYHLVKYRGHFLFDHLKIENLTNNDNMHDFVELIETYENLNNIKLNLD
YEKTKVIYEILKDNEMTKNDRAKRVKNMEKKLEQFSIMLLGLKFNEGKLFNHADNAEELKGANQ
SHTFADNYEENLTPFLTVEQSEFIERANKIYLSLTLQDILKGKKSMAMSKVAAYDKFRNELKQV
KDIVYKADSTRTQFKKIFVSSKKSLKQYDATPNDQTFSSLCLFDQYLIRPKKQYSLLIKELKKI
IPQDSELYFEAENDTLLKVLNTTDNASIPMQINLYEAETILRNQQKYHAEITDEMIEKVLSLIQ
FRIPYYVGPLVNDHTASKFGWMERKSNESIKPWNFDEVVDRSKSATQFIRRMTNKCSYLINEDV
LPKNSLLYQEMEVLNELNATQIRLQTDPKNRKYRMMPQIKLFAVEHIFKKYKTVSHSKFLEIML
NSNHRENFMNHGEKLSIFGTQDDKKFASKLSSYQDMTKIFGDIEGKRAQIEEIIQWITIFEDKK
ILVQKLKECYPELTSKQINQLKKLNYSGWGRLSEKLLTHAYQGHSIIELLRHSDENFMEILTND
VYGFQNFIKEENQVQSNKIQHQDIANLTTSPALKKGIWSTIKLVRELTSIFGEPEKIIMEFATE
DQQKGKKQKSRKQLWDDNIKKNKLKSVDEYKYIIDVANKLNNEQLQQEKLWLYLSQNGKCMYSG
QSIDLDALLSPNATKHYEVDHIFPRSFIKDDSIDNKVLVIKKMNQTKGDQVPLQFIQQPYERIA
YWKSLNKAGLISDSKLHKLMKPEFTAMDKEGFIQRQLVETRQISVHVRDFLKEEYPNTKVIPMK
AKMVSEFRKKFDIPKIRQMNDAHHAIDAYLNGVVYHGAQLAYPNVDLFDFNFKWEKVREKWKAL
GEFNTKQKSRELFFFKKLEKMEVSQGERLISKIKLDMNHFKINYSRKLANIPQQFYNQTAVSPK
TAELKYESNKSNEVVYKGLTPYQTYVVAIKSVNKKGKEKMEYQMIDHYVFDFYKFQNGNEKELA
LYLAQRENKDEVLDAQIVYSLNKGDLLYINNHPCYFVSRKEVINAKQFELTVEQQLSLYNVMNN
KETNVEKLLIEYDFIAEKVINEYHHYLNSKLKEKRVRTFFSESNQTHEDFIKALDELFKVVTAS
ATRSDKIGSRKNSMTHRAFLGKGKDVKIAYTSISGLKTTKPKSLFKLAESRNEL

SEQ ID NO: 331
MAKILGLDLGTNSIGWAVVERENIDFSLIDKGVRIFSEGVKSEKGIESSRAAERTGYRSARKIK
YRRKLRKYETLKVLSLNRMCPLSIEEVEEWKKSGFKDYPLNPEFLKWLSTDEESNVNPYFFRDR
ASKHKVSLFELGRAFYHIAQRRGFLSNRLDQSAEGILEEHCPKIEAIVEDLISIDEISTNITDY
FFETGILDSNEKNGYAKDLDEGDKKLVSLYKSLLAILKKNESDFENCKSEIIERLNKKDVLGKV
KGKIKDISQAMLDGNYKTLGQYFYSLYSKEKIRNQYTSREEHYLSEFITICKVQGIDQINEEEK
INEKKFDGLAKDLYKAIFFQRPLKSQKGLIGKCSFEKSKSRCAISHPDFEEYRMWTYLNTIKIG
TQSDKKLRFLTQDEKLKLVPKFYRKNDFNFDVLAKELIEKGSSFGFYKSSKKNDFFYWFNYKPT
DTVAACQVAASLKNAIGEDWKTKSFKYQTINSNKEQVSRTVDYKDLWHLLTVATSDVYLYEFAI
DKLGLDEKNAKAFSKTKLKKDFASLSLSAINKILPYLKEGLLYSHAVFVANIENIVDENIWKDE
KQRDYIKTQISEIIENYTLEKSRFEIINGLLKEYKSENEDGKRVYYSKEAEQSFENDLKKKLVL
FYKSNEIENKEQQETIFNELLPIFIQQLKDYEFIKIQRLDQKVLIFLKGKNETGQIFCTEEKGT
AEEKEKKIKNRLKKLYHPSDIEKFKKKIIKDEFGNEKIVLGSPLTPSIKNPMAMRALHQLRKVL
NALILEGQIDEKTIIHIEMARELNDANKRKGIQDYQNDNKKFREDAIKEIKKLYFEDCKKEVEP
TEDDILRYQLWMEQNRSEIYEEGKNISICDIIGSNPAYDIEHTIPRSRSQDNSQMNKTLCSQRF
NREVKKQSMPIELNNHLEILPRIAHWKEEADNLTREIEIISRSIKAAATKEIKDKKIRRRHYLT
LKRDYLQGKYDRFIWEEPKVGFKNSQIPDTGIITKYAQAYLKSYFKKVESVKGGMVAEFRKIWG
IQESFIDENGMKHYKVKDRSKHTHHTIDAITIACMTKEKYDVLAHAWTLEDQQNKKEARSIIEA
SKPWKTFKEDLLKIEEEILVSHYTPDNVKKQAKKIVRVRGKKQFVAEVERDVNGKAVPKKAASG

KTIYKLDGEGKKLPRLQQGDTIRGSLHQDSIYGAIKNPLNTDEIKYVIRKDLESIKGSDVESIV

DEVVKEKIKEAIANKVLLLSSNAQQKNKLVGTVWMNEEKRIAINKVRIYANSVKNPLHIKEHSL

LSKSKHVHKQKVYGQNDENYAMAIYELDGKRDFELINIFNLAKLIKQGQGFYPLHKKKEIKGKI

VFVPIEKRNKRDVVLKRGQQVVFYDKEVENPKDISEIVDFKGRIYIIEGLSIQRIVRPSGKVDE

YGVIMLRYFKEARKADDIKQDNFKPDGVFKLGENKPTRKMNHQFTAFVEGIDFKVLPSGKFEKI

SEQ ID NO: 332
MEFKKVLGLDIGTNSIGCALLSLPKSIQDYGKGGRLEWLTSRVIPLDADYMKAFIDGKNGLPQV

ITPAGKRRQKRGSRRLKHRYKLRRSRLIRVFKTLNWLPEDFPLDNPKRIKETISTEGKFSFRIS

DYVPISDESYREFYREFGYPENEIEQVIEEINFRRKTKGKNKNPMIKLLPEDWVVYYLRKKALI

KPTTKEELIRIIYLFNQRRGFKSSRKDLTETAILDYDEFAKRLAEKEKYSAENYETKFVSITKV

KEVVELKTDGRKGKKRFKVILEDSRIEPYEIERKEKPDWEGKEYTFLVTQKLEKGKFKQNKPDL

PKEEDWALCTTALDNRMGSKHPGEFFFDELLKAFKEKRGYKIRQYPVNRWRYKKELEFIWTKQC

QLNPELNNLNINKEILRKLATVLYPSQSKFFGPKIKEFENSDVLHIISEDIIYYQRDLKSQKSL

ISECRYEKRKGIDGEIYGLKCIPKSSPLYQEFRIWQDIHNIKVIRKESEVNGKKKINIDETQLY

INENIKEKLFELFNSKDSLSEKDILELISLNIINSGIKISKKEEETTHRINLFANRKELKGNET

KSRYRKVFKKLGFDGEYILNHPSKLNRLWHSDYSNDYADKEKTEKSILSSLGWKNRNGKWEKSK

NYDVFNLPLEVAKAIANLPPLKKEYGSYSALAIRKMLVVMRDGKYWQHPDQIAKDQENTSLMLF

DKNLIQLTNNQRKVLNKYLLTLAEVQKRSTLIKQKLNEIEHNPYKLELVSDQDLEKQVLKSFLE

KKNESDYLKGLKTYQAGYLIYGKHSEKDVPIVNSPDELGEYIRKKLPNNSLRNPIVEQVIRETI

FIVRDVWKSFGIIDEIHIELGRELKNNSEERKKTSESQEKNFQEKERARKLLKELLNSSNFEHY

DENGNKIFSSFTVNPNPDSPLDIEKFRIWKNQSGLTDEELNKKLKDEKIPTEIEVKKYILWLTQ

KCRSPYTGKIIPLSKLFDSNVYEIEHIIPRSKMKNDSTNNLVICELGVNKAKGDRLAANFISES

NGKCKFGEVEYTLLKYGDYLQYCKDTFKYQKAKYKNLLATEPPEDFIERQINDTRYIGRKLAEL

LTPVVKDSKNIIFTIGSITSELKITWGLNGVWKDILRPRFKRLESIINKKLIFQDEDDPNKYHF

DLSINPQLDKEGLKRLDHRHHALDATIIAATTREHVRYLNSLNAADNDEEKREYFLSLCNHKIR

DFKLPWENFTSEVKSKLLSCVVSYKESKPILSDPFNKYLKWEYKNGKWQKVFAIQIKNDRWKAV

RRSMFKEPIGTVWIKKIKEVSLKEAIKIQAIWEEVKNDPVRKKKEKYIYDDYAQKVIAKIVQEL

GLSSSMRKQDDEKLNKFINEAKVSAGVNKNLNTTNKTIYNLEGRFYEKIKVAEYVLYKAKRMPL

NKKEYIEKLSLQKMFNDLPNFILEKSILDNYPEILKELESDNKYIIEPHKKNNPVNRLLLEHIL

EYHNNPKEAFSTEGLEKLNKKAINKIGKPIKYITRLDGDINEEEIFRGAVFETDKGSNVYFVMY

ENNQTKDREFLKPNPSISVLKAIEHKNKIDFFAPNRLGFSRIILSPGDLVYVPTNDQYVLIKDN

SSNETIINWDDNEFISNRIYQVKKFTGNSCYFLKNDIASLILSYSASNGVGEFGSQNISEYSVD

DPPIRIKDVCIKIRVDRLGNVRPL

SEQ ID NO: 333
MKHILGLDLGTNSIGWALIERNIEEKYGKIIGMGSRIVPMGAELSKFEQGQAQTKNADRRTNRG

ARRLNKRYKQRRNKLIYILQKLDMLPSQIKLKEDFSDPNKIDKITILPISKKQEQLTAFDLVSL

RVKALTEKVGLEDLGKIIYKYNQLRGYAGGSLEPEKEDIFDEEQSKDKKNKSFIAFSKIVFLGE

PQEEIFKNKKLNRRAIIVETEEGNFEGSTFLENIKVGDSLELLINISASKSGDTITIKLPNKTN

WRKKMENIENQLKEKSKEMGREFYISEFLLELLKENRWAKIRNNTILRARYESEFEAIWNEQVK

HYPFLENLDKKTLIEIVSFIFPGEKESQKKYRELGLEKGLKYIIKNQVVFYQRELKDQSHLISD

CRYEPNEKAIAKSHPVFQEYKVWEQINKLIVNTKIEAGTNRKGEKKYKYIDRPIPTALKEWIFE

ELQNKKEITFSAIFKKLKAEFDLREGIDFLNGMSPKDKLKGNETKLQLQKSLGELWDVLGLDSI

-continued

NRQIELWNILYNEKGNEYDLTSDRTSKVLEFINKYGNNIVDDNAEETAIRISKIKFARAYSSLS

LKAVERILPLVRAGKYFNNDFSQQLQSKILKLLNENVEDPFAKAAQTYLDNNQSVLSEGGVGNS

IATILVYDKHTAKEYSHDELYKSYKEINLLKQGDLRNPLVEQIINEALVLIRDIWKNYGIKPNE

IRVELARDLKNSAKERATIHKRNKDNQTINNKIKETLVKNKKELSLANIEKVKLWEAQRHLSPY

TGQPIPLSDLFDKEKYDVDHIIPISRYFDDSFTNKVISEKSVNQEKANRTAMEYFEVGSLKYSI

FTKEQFIAHVNEYFSGVKRKNLLATSIPEDPVQRQIKDTQYIAIRVKEELNKIVGNENVKTTTG

SITDYLRNHWGLTDKFKLLLKERYEALLESEKFLEAEYDNYKKDFDSRKKEYEEKEVLFEEQEL

TREEFIKEYKENYIRYKKNKLIIKGWSKRIDHRHHAIDALIVACTEPAHIKRLNDLNKVLQDWL

VEHKSEFMPNFEGSNSELLEEILSLPENERTEIFTQIEKFRAIEMPWKGFPEQVEQKLKEIIIS

HKPKDKLLLQYNKAGDRQIKLRGQLHEGTLYGISQGKEAYRIPLTKFGGSKFATEKNIQKIVSP

FLSGFIANHLKEYNNKKEEAFSAEGIMDLNNKLAQYRNEKGELKPHTPISTVKIYYKDPSKNKK

KKDEEDLSLQKLDREKAFNEKLYVKTGDNYLFAVLEGEIKTKKTSQIKRLYDIISFFDATNFLK

EEFRNAPDKKTFDKDLLFRQYFEERNKAKLLFTLKQGDFVYLPNENEEVILDKESPLYNQYWGD

LKERGKNIYVVQKFSKKQIYFIKHTIADIIKKDVEFGSQNCYETVEGRSIKENCFKLEIDRLGN

IVKVIKR

SEQ ID NO: 334
MHVEIDFPHFSRGDSHLAMNKNEILRGSSVLYRLGLDLGSNSLGWFVTHLEKRGDRHEPVALGP

GGVRIFPDGRDPQSGTSNAVDRRMARGARKRRDRFVERRKELIAALIKYNLLPDDARERRALEV

LDPYALRKTALTDTLPAHHVGRALFHLNQRRGFQSNRKTDSKQSEDGAIKQAASRLATDKGNET

LGVFFADMHLRKSYEDRQTAIRAELVRLGKDHLTGNARKKIWAKVRKRLFGDEVLPRADAPHGV

RARATITGTKASYDYYPTRDMLRDEFNAIWAGQSAHHATITDEARTEIEHIIFYQRPLKPAIVG

KCTLDPATRPFKEDPEGYRAPWSHPLAQRFRILSEARNLEIRDTGKGSRRLTKEQSDLVVAALL

ANREVKFDKLRTLLKLPAEARFNLESDRRAALDGDQTAARLSDKKGFNKAWRGFPPERQIAIVA

RLEETEDENELIAWLEKECALDGAAAARVANTTLPDGHCRLGLRAIKKIVPIMQDGLDEDGVAG

AGYHIAAKRAGYDHAKLPTGEQLGRLPYYGQWLQDAVVGSGDARDQKEKQYGQFPNPTVHIGLG

QLRRVVNDLIDKYGPPTEISIEFTRALKLSEQQKAERQREQRRNQDKNKARAEELAKFGRPANP

RNLLKMRLWEELAHDPLDRKCVYTGEQISIERLLSDEVDIDHILPVAMTLDDSPANKIICMRYA

NRHKRKQTPSEAFGSSPTLQGHRYNWDDIAARATGLPRNKRWRFDANAREEFDKRGGFLARQLN

ETGWLARLAKQYLGAVTDPNQIWVVPGRLTSMLRGKWGLNGLLPSDNYAGVQDKAEEFLASTDD

MEFSGVKNRADHRHHAIDGLVTALTDRSLLWKMANAYDEEHEKFVIEPPWPTMRDDLKAALEKM

VVSHKPDHGIEGKLHEDSAYGFVKPLDATGLKEEEAGNLVYRKAIESLNENEVDRIRDIQLRTI

VRDHVNVEKTKGVALADALRQLQAPSDDYPQFKHGLRHVRILKKEKGDYLVPIANRASGVAYKA

YSAGENFCVEVFETAGGKWDGEAVRRFDANKKNAGPKIAHAPQWRDANEGAKLVMRIHKGDLIR

LDHEGRARIMVVHRLDAAAGRFKLADHNETGNLDKRHATNNDIDPFRWLMASYNTLKKLAAVPV

RVDELGRVWRVMPN

SEQ ID NO: 335
METTLGIDLGTNSIGLALVDQEEHQILYSGVRIFPEGINKDTIGLGEKEESRNATRRAKRQMRR

QYFRKKLRKAKLLELLIAYDMCPLKPEDVRRWKNWDKQQKSTVRQFPDTPAFREWLKQNPYELR

KQAVTEDVTRPELGRILYQMIQRRGFLSSRKGKEEGKIFTGKDRMVGIDETRKNLQKQTLGAYL

YDIAPKNGEKYRFRTERVRARYTLRDMYIREFEIIWQRQAGHLGLAHEQATRKKNIFLEGSATN

VRNSKLITHLQAKYGRGHVLIEDTRITVTFQLPLKEVLGGKIEIEEEQLKFKSNESVLFWQRPL

-continued

RSQKSLLSKCVFEGRNFYDPVHQKWIIAGPTPAPLSHPEFEEFRAYQFINNIIYGKNEHLTAIQ

REAVFELMCTESKDFNFEKIPKHLKLFEKFNFDDTTKVPACTTISQLRKLFPHPVWEEKREEIW

HCFYFYDDNTLLFEKLQKDYALQTNDLEKIKKIRLSESYGNVSLKAIRRINPYLKKGYAYSTAV

LLGGIRNSFGKRFEYFKEYEPEIEKAVCRILKEKNAEGEVIRKIKDYLVHNRFGAKNDRAFQK

LYHHSQAITTQAQKERLPETGNLRNPIVQQGLNELRRTVNKLLATCREKYGPSFKFDHIHVEMG

RELRSSKTEREKQSRQIRENEKKNEAAKVKLAEYGLKAYRDNIQKYLLYKEIEEKGGTVCCPYT

GKTLNISHTLGSDNSVQIEHIIPYSISLDDSLANKTLCDATFNREKGELTPYDFYQKDPSPEKW

GASSWEEIEDRAFRLLPYAKAQRFIRRKPQESNEFISRQLNDTRYISKKAVEYLSAICSDVKAF

PGQLTAELRHLWGLNNILQSAPDITFPLPVSATENHREYYVITNEQNEVIRLFPKQGETPRTEK

GELLLTGEVERKVFRCKGMQEFQTDVSDGKYWRRIKLSSSVTWSPLFAPKPISADGQIVLKGRI

EKGVFVCNQLKQKLKTGLPDGSYWISLPVISQTFKEGESVNNSKLTSQQVQLFGRVREGIFRCH

NYQCPASGADGNFWCTLDTDTAQPAFTPIKNAPPGVGGGQIILTGDVDDKGIFHADDDLHYELP

ASLPKGKYYGIFTVESCDPTLIPIELSAPKTSKGENLIEGNIWVDEHTGEVRFDPKKNREDQRH

HAIDAIVIALSSQSLFQRLSTYNARRENKKRGLDSTEHFPSPWPGFAQDVRQSVVPLLVSYKQN

PKTLCKISKTLYKDGKKIHSCGNAVRGQLHKETVYGQRTAPGATEKSYHIRKDIRELKTSKHIG

KVVDITIRQMLLKHLQENYHIDITQEFNIPSNAFFKEGVYRIFLPNKHGEPVPIKKIRMKEELG

NAERLKDNINQYVNPRNNHHVMIYQDADGNLKEEIVSFWSVIERQNQGQPIYQLPREGRNIVSI

LQINDTFLIGLKEEEPEVYRNDLSTLSKHLYRVQKLSGMYYTFRHHLASTLNNEREEFRIQSLE

AWKRANPVKVQIDEIGRITFLNGPLC

SEQ ID NO: 336
MESSQILSPIGIDLGGKFTGVCLSHLEAFAELPNHANTKYSVILIDHNNFQLSQAQRRATRHRV

RNKKRNQFVKRVALQLFQHILSRDLNAKEETALCHYLNNRGYTYVDTDLDEYIKDETTINLLKE

LLPSESEHNFIDWFLQKMQSSEFRKILVSKVEEKKDDKELKNAVKNIKNFITGFEKNSVEGHRH

RKVYFENIKSDITKDNQLDSIKKKIPSVCLSNLLGHLSNLQWKNLHRYLAKNPKQFDEQTFGNE

FLRMLKNFRHLKGSQESLAVRNLIQQLEQSQDYISILEKTPPEITIPPYEARTNTGMEKDQSLL

LNPEKLNNLYPNWRNLIPGIIDAHPFLEKDLEHTKLRDRKRIISPSKQDEKRDSYILQRYLDLN

KKIDKFKIKKQLSFLGQGKQLPANLIETQKEMETHFNSSLVSVLIQIASAYNKEREDAAQGIWF

DNAFSLCELSNINPPRKQKILPLLVGAILSEDFINNKDKWAKFKIFWNTHKIGRTSLKSKCKEI

EEARKNSGNAFKIDYEEALNHPEHSNNKALIKIIQTIPDIIQAIQSHLGHNDSQALIYHNPFSL

SQLYTILETKRDGFHKNCVAVTCENYWRSQKTEIDPEISYASRLPADSVRPFDGVLARMMQRLA

YEIAMAKWEQIKHIPDNSSLLIPIYLEQNRFEFEESFKKIKGSSSDKTLEQAIEKQNIQWEEKF

QRIINASMNICPYKGASIGGQGEIDHIYPRSLSKKHFGVIFNSEVNLIYCSSQGNREKKEEHYL

LEHLSPLYLKHQFGTDNVSDIKNFISQNVANIKKYISFHLLTPEQQKAARHALFLDYDDEAFKT

ITKFLMSQQKARVNGTQKFLGKQIMEFLSTLADSKQLQLEFSIKQITAEEVHDHRELLSKQEPK

LVKSRQQSFPSHAIDATLTMSIGLKEFPQFSQELDNSWFINHLMPDEVHLNPVRSKEKYNKPNI

SSTPLFKDSLYAERFIPVWVKGETFAIGFSEKDLFEIKPSNKEKLFTLLKTYSTKNPGESLQEL

QAKSKAKWLYFPINKTLALEFLHHYFHKEIVTPDDTTVCHFINSLRYYTKKESITVKILKEPMP

VLSVKFESSKKNVLGSFKHTIALPATKDWERLFNHPNFLALKANPAPNPKEFNEFIRKYFLSDN

NPNSDIPNNGHNIKPQKHKAVRKVFSLPVIPGNAGTMMRIRRKDNKGQPLYQLQTIDDTPSMGI

QINEDRLVKQEVLMDAYKTRNLSTIDGINNSEGQAYATFDNWLTLPVSTFKPEIIKLEMKPHSK

TRRYIRITQSLADFIKTIDEALMIKPSDSIDDPLNMPNEIVCKNKLFGNELKPRDGKMKIVSTG

KIVTYEFESDSTPQWIQTLYVTQLKKQP

SEQ ID NO: 337

MKKIVGLDLGTNSIGWALINAYINKEHLYGIEACGSRIIPMDAAILGNFDKGNSISQTADRTSY

RGIRRLRERHLLRRERLHRILDLLGFLPKHYSDSLNRYGKFLNDIECKLPWVKDETGSYKFIFQ

ESFKEMLANFTEHHPILIANNKKVPYDWTIYYLRKKALTQKISKEELAWILLNFNQKRGYYQLR

GEEEETPNKLVEYYSLKVEKVEDSGERKGKDTWYNVHLENGMIYRRTSNIPLDWEGKTKEFIVT

TDLEADGSPKKDKEGNIKRSFRAPKDDDWTLIKKKTEADIDKIKMTVGAYIYDTLLQKPDQKIR

GKLVRTIERKYYKNELYQILKTQSEFHEELRDKQLYIACLNELYPNNEPRRNSISTRDFCHLFI

EDIIFYQRPLKSKKSLIDNCPYEENRYIDKESGEIKHASIKCIAKSHPLYQEFRLWQFIVNLRI

YRKETDVDVTQELLPTEADYVTLFEWLNEKKEIDQKAFFKYPPFGFKKTTSNYRWNYVEDKPYP

CNETHAQIIARLGKAHIPKAFLSKEKEETLWHILYSIEDKQEIEKALHSFANKNNLSEEFIEQF

KNFPPFKKEYGSYSAKAIKKLLPLMRMGKYWSIENIDNGTRIRINKIIDGEYDENIRERVRQKA

INLTDITHFRALPLWLACYLVYDRHSEVKDIVKWKTPKDIDLYLKSFKQHSLRNPIVEQVITET

LRTVRDIWQQVGHIDEIHIELGREMKNPADKRARMSQQMIKNENTNLRIKALLTEFLNPEFGIE

NVRPYSPSQQDLLRIYEEGVLNSILELPEDIGIILGKFNQTDTLKRPTRSEILRYKLWLEQKYR

SPYTGEMIPLSKLFTPAYEIEHIIPQSRYFDDSLSNKVICESEINKLKDRSLGYEFIKNHHGEK

VELAFDKPVEVLSVEAYEKLVHESYSHNRSKMKKLLMEDIPDQFIERQLNDSRYISKVVKSLLS

NIVREENEQEAISKNVIPCTGGITDRLKKDWGINDVWNKIVLPRFIRLNELTESTRFTSINTNN

TMIPSMPLELQKGFNKKRIDHRHHAMDAIIIACANRNIVNYLNNVSASKNTKITRRDLQTLLCH

KDKTDNNGNYKWVIDKPWETFTQDTLTALQKITVSFKQNLRVINKTTNHYQHYENGKKIVSNQS

KGDSWAIRKSMHKETVHGEVNLRMIKTVSFNEALKKPQAIVEMDLKKKILAMLELGYDTKRIKN

YFEENKDTWQDINPSKIKVYYFTKETKDRYFAVRKPIDTSFDKKKIKESITDTGIQQIMLRHLE

TKDNDPTLAFSPDGIDEMNRNILILNKGKKHQPIYKVRVYEKAEKFTVGQKGNKRTKFVEAAKG

TNLFFAIYETEEIDKDTKKVIRKRSYSTIPLNVVIERQKQGLSSAPEDENGNLPKYILSPNDLV

YVPTQEEINKGEVVMPIDRDRIYKMVDSSGITANFIPASTANLIFALPKATAEIYCNGENCIQN

EYGIGSPQSKNQKAITGEMVKEICFPIKVDRLGNIIQVGSCILTN

SEQ ID NO: 338

MSRSLTFSFDIGYASIGWAVIASASHDDADPSVCGCGTVLFPKDDCQAFKRREYRRLRRNIRSR

RVRIERIGRLLVQAQIITPEMKETSGHPAPFYLASEALKGHRTLAPIELWHVLRWYAHNRGYDN

NASWSNSLSEDGGNGEDTERVKHAQDLMDKHGTATMAETICRELKLEEGKADAPMEVSTPAYKN

LNTAFPRLIVEKEVRRILELSAPLIPGLTAEIIELIAQHHPLTTEQRGVLLQHGIKLARRYRGS

LLFGQLIPRFDNRIISRCPVTWAQVYEAELKKGNSEQSARERAEKLSKVPTANCPEFYEYRMAR

ILCNIRADGEPLSAEIRRELMNQARQEGKLTKASLEKAISSRLGKETETNVSNYFTLHPDSEEA

LYLNPAVEVLQRSGIGQILSPSVYRIAANRLRRGKSVTPNYLLNLLKSRGESGEALEKKIEKES

KKKEADYADTPLKPKYATGRAPYARTVLKKVVEEILDGEDPTRPARGEAHPDGELKAHDGCLYC

LLDTDSSVNQHQKERRLDTMTNNHLVRHRMLILDRLLKDLIQDFADGQKDRISRVCVEVGKELT

TFSAMDSKKIQRELTLRQKSHTDAVNRLKRKLPGKALSANLIRKCRIAMDMNWTCPFTGATYGD

HELENLELEHIVPHSFRQSNALSSLVLTWPGVNRMKGQRTGYDFVEQEQENPVPDKPNLHICSL

NNYRELVEKLDDKKGHEDDRRRKKKRKALLMVRGLSHKHQSQNHEAMKEIGMTEGMMTQSSHLM

-continued

KLACKSIKTSLPDAHIDMIPGAVTAEVRKAWDVFGVFKELCPEAADPDSGKILKENLRSLTHLH

HALDACVLGLIPYIIPAHHNGLLRRVLAMRRIPEKLIPQVRPVANQRHYVLNDDGRMMLRDLSA

SLKENIREQLMEQRVIQHVPADMGGALLKETMQRVLSVDGSGEDAMVSLSKKKDGKKEKNQVKA

SKLVGVFPEGPSKLKALKAAIEIDGNYGVALDPKPVVIRHIKVFKRIMALKEQNGGKPVRILKK

GMLIHLTSSKDPKHAGVWRIESIQDSKGGVKLDLQRAHCAVPKNKTHECNWREVDLISLLKKYQ

MKRYPTSYTGTPR

SEQ ID NO: 339
MTQKVLGLDLGTNSIGSAVRNLDLSDDLQWQLEFFSSDIFRSSVNKESNGREYSLAAQRSAHRR

SRGLNEVRRRRLWATLNLLIKHGFCPMSSESLMRWCTYDKRKGLFREYPIDDKDFNAWILLDFN

GDGRPDYSSPYQLRRELVTRQFDFEQPIERYKLGRALYHIAQHRGFKSSKGETLSQQETNSKPS

STDEIPDVAGAMKASEEKLSKGLSTYMKEHNLLTVGAAFAQLEDEGVRVRNNNDYRAIRSQFQH

EIETIFKFQQGLSVESELYERLISEKKNVGTIFYKRPLRSQRGNVGKCTLERSKPRCAIGHPLF

EKFRAWTLINNIKVRMSVDTLDEQLPMKLRLDLYNECFLAFVRTEFKFEDIRKYLEKRLGIHFS

YNDKTINYKDSTSVAGCPITARFRKMLGEEWESFRVEGQKERQAHSKNNISFHRVSYSIEDIWH

FCYDAEEPEAVLAFAQETLRLERKKAEELVRIWSAMPQGYAMLSQKAIRNINKILMLGLKYSDA

VILAKVPELVDVSDEELLSIAKDYYLVEAQVNYDKRINSIVNGLIAKYKSVSEEYRFADHNYEY

LLDESDEKDIIRQIENSLGARRWSLMDANEQTDILQKVRDRYQDFFRSHERKFVESPKLGESFE

NYLTKKFPMVEREQWKKLYHPSQITIYRPVSVGKDRSVLRLGNPDIGAIKNPTVLRVLNTLRRR

VNQLLDDGVISPDETRVVVETARELNDANRKWALDTYNRIRHDENEKIKKILEEFYPKRDGIST

DDIDKARYVIDQREVDYFTGSKTYNKDIKKYKFWLEQGGQCMYTGRTINLSNLFDPNAFDIEHT

IPESLSFDSSDMNLTLCDAHYNRFIKKNHIPTDMPNYDKAITIDGKEYPAITSQLQRWVERVER

LNRNVEYWKGQARRAQNKDRKDQCMREMHLWKMELEYWKKKLERFTVTEVTDGFKNSQLVDTRV

ITRHAVLYLKSIFPHVDVQRGDVTAKFRKILGIQSVDEKKDRSLHSHHAIDATTLTIIPVSAKR

DRMLELFAKIEEINKMLSFSGSEDRTGLIQELEGLKNKLQMEVKVCRIGHNVSEIGTFINDNII

VNHHIKNQALTPVRRRLRKKGYIVGGVDNPRWQTGDALRGEIHKASYYGAITQFAKDDEGKVLM

KEGRPQVNPTIKFVIRRELKYKKSAADSGFASWDDLGKAIVDKELFALMKGQFPAETSFKDACE

QGIYMIKKGKNGMPDIKLHHIRHVRCEAPQSGLKIKEQTYKSEKEYKRYFYAAVGDLYAMCCYT

NGKIREFRIYSLYDVSCHRKSDIEDIPEFITDKKGNRLMLDYKLRTGDMILLYKDNPAELYDLD

NVNLSRRLYKINRFESQSNLVLMTHHLSTSKERGRSLGKTVDYQNLPESIRSSVKSLNFLIMGE

NRDFVIKNGKIIFNHR

SEQ ID NO: 340
MLVSPISVDLGGKNTGFFSFTDSLDNSQSGTVIYDESFVLSQVGRRSKRHSKRNNLRNKLVKRL

FLLILQEHHGLSIDVLPDEIRGLFNKRGYTYAGFELDEKKKDALESDTLKEFLSEKLQSIDRDS

DVEDFLNQIASNAESFKDYKKGFEAVFASATHSPNKKLELKDELKSEYGENAKELLAGLRVTKE

ILDEFDKQENQGNLPRAKYFEELGEYIATNEKVKSFFDSNSLKLTDMTKLIGNISNYQLKELRR

YFNDKEMEKGDIWIPNKLHKITERFVRSWHPKNDADRQRRAELMKDLKSKEIMELLTTTEPVMT

IPPYDDMNNRGAVKCQTLRLNEEYLDKHLPNWRDIAKRLNHGKFNDDLADSTVKGYSEDSTLLH

RLLDTSKEIDIYELRGKKPNELLVKTLGQSDANRLYGFAQNYYELIRQKVRAGIWVPVKNKDDS

LNLEDNSNMLKRCNHNPPHKKNQIHNLVAGILGVKLDEAKFAEFEKELWSAKVGNKKLSAYCKN

IEELRKTHGNTFKIDIEELRKKDPAELSKEEKAKLRLTDDVILNEWSQKIANFFDIDDKHRQRF

NNLFSMAQLHTVIDTPRSGFSSTCKRCTAENRFRSETAFYNDETGEFHKKATATCQRLPADTQR

PFSGKIERYIDKLGYELAKIKAKELEGMEAKEIKVPIILEQNAFEYEESLRKSKTGSNDRVINS

-continued

KKDRDGKKLAKAKENAEDRLKDKDKRIKAFSSGICPYCGDTIGDDGEIDHILPRSHTLKIYGTV
FNPEGNLIYVHQKCNQAKADSIYKLSDIKAGVSAQWIEEQVANIKGYKTFSVLSAEQQKAFRYA
LFLQNDNEAYKKVVDWLRTDQSARVNGTQKYLAKKIQEKLTKMLPNKHLSFEFILADATEVSEL
RRQYARQNPLLAKAEKQAPSSHAIDAVMAFVARYQKVFKDGTPPNADEVAKLAMLDSWNPASNE
PLTKGLSTNQKIEKMIKSGDYGQKNMREVFGKSIFGENAIGERYKPIVVQEGGYYIGYPATVKK
GYELKNCKVVTSKNDIAKLEKIIKNQDLISLKENQYIKIFSINKQTISELSNRYFNMNYKNLVE
RDKEIVGLLEFIVENCRYYTKKVDVKFAPKYIHETKYPFYDDWRRFDEAWRYLQENQNKTSSKD
RFVIDKSSLNEYYQPDKNEYKLDVDTQPIWDDFCRWYFLDRYKTANDKKSIRIKARKTFSLLAE
SGVQGKVFRAKRKIPTGYAYQALPMDNNVIAGDYANILLEANSKTLSLVPKSGISIEKQLDKKL
DVIKKTDVRGLAIDNNSFFNADFDTHGIRLIVENTSVKVGNFPISAIDKSAKRMIFRALFEKEK
GKRKKKTTISFKESGPVQDYLKVFLKKIVKIQLRTDGSISNIVVRKNAADFTLSFRSEHIQKLL
K

SEQ ID NO: 341
MAYRLGLDIGITSVGWAVVALEKDESGLKPVRIQDLGVRIFDKAEDSKTGASLALPRREARSAR
RRTRRRRHRLWRVKRLLEQHGILSMEQIEALYAQRTSSPDVYALRVAGLDRCLIAEEIARVLIH
IAHRRGFQSNRKSEIKDSDAGKLLKAVQENENLMQSKGYRTVAEMLVSEATKTDAEGKLVHGKK
HGYVSNVRNKAGEYRHTVSRQAIVDEVRKIFAAQRALGNDVMSEELEDSYLKILCSQRNFDDGP
GGDSPYGHGSVSPDGVRQSIYERMVGSCTFETGEKRAPRSSYSFERFQLLTKVVNLRIYRQQED
GGRYPCELTQTERARVIDCAYEQTKITYGKLRKLLDMKDTESFAGLTYGLNRSRNKTEDTVFVE
MKFYHEVRKALQRAGVFIQDLSIETLDQIGWILSVWKSDDNRRKKLSTLGLSDNVIEELLPLNG
SKFGHLSLKAIRKILPFLEDGYSYDVACELAGYQFQGKTEYVKQRLLPPLGEGEVTNPVVRRAL
SQAIKVVNAVIRKHGSPESIHIELARELSKNLDERRKIEKAQKENQKNNEQIKDEIREILGSAH
VTGRDIVKYKLFKQQQEFCMYSGEKLDVTRLFEPGYAEVDHIIPYGISFDDSYDNKVLVKTEQN
RQKGNRTPLEYLRDKPEQKAKFIALVESIPLSQKKKNHLLMDKRAIDLEQEGFRERNLSDTRYI
TRALMNHIQAWLLFDETASTRSKRVVCVNGAVTAYMRARWGLTKDRDAGDKHHAADAVVVACIG
DSLIQRVTKYDKFKRNALADRNRYVQQVSKSEGITQYVDKETGEVFTWESFDERKFLPNEPLEP
WPFFRDELLARLSDDPSKNIRAIGLLTYSETEQIDPIFVSRMPTRKVTGAAHKETIRSPRIVKV
DDNKGTEIQVVSKVALTELKLTKDGEIKDYFRPEDDPRLYNTLRERLVQFGGDAKAAFKEPVY
KISKDGSVRTPVRKVKIQEKLTLGVPVHGGRGIAENGGMVRIDVFAKGGKYYFVPIYVADVLKR
ELPNRLATAHKPYSEWRVVDDSYQFKFSLYPNDAVMIKPSREVDITYKDRKEPVGCRIMYFVSA
NIASASISLRTHDNSGELEGLGIQGLEVFEKYVVGPLGDTHPVYKERRMPFRVERKMN

SEQ ID NO: 342
MPVLSPLSPNAAQGRRRWSLALDIGEGSIGWAVAEVDAEGRVLQLTGTGVTLFPSAWSNENGTY
VAHGAADRAVRGQQQRHDSRRRRLAGLARLCAPVLERSPEDLKDLTRTPPKADPRAIFFLRADA
ARRPLDGPELFRVLHHMAAHRGIRLAELQEVDPPPESDADDAAPAATEDEDGTRRAAADERAFR
RLMAEHMHRHGTQPTCGEIMAGRLRETPAGAQPVTRARDGLRVGGGVAVPTRALIEQEFDAIRA
IQAPRHPDLPWDSLRRLVLDQAPIAVPPATPCLFLEELRRRGETFQGRTITREAIDRGLTVDPL
IQALRIRETVGNLRLHERITEPDGRQRYVPRAMPELGLSHGELTAPERDTLVRALMHDPDGLAA
KDGRIPYTRLRKLIGYDNSPVCFAQERDTSGGGITVNPTDPLMARWIDGWVDLPLKARSLYVRD
VVARGADSAALARLLAEGAHGVPPVAAAAVPAATAAILESDIMQPGRYSVCPWAAEAILDAWAN
APTEGFYDVTRGLFGFAPGEIVLEDLRRARGALLAHLPRTMAAARTPNRAAQQRGPLPAYESVI

-continued

PSQLITSLRRAHKGRAADWSAADPEERNPFLRTWTGNAATDHILNQVRKTANEVITKYGNRRGW

DPLPSRITVELAREAKHGVIRRNEIAKENRENEGRRKKESAALDTFCQDNTVSWQAGGLPKERA

ALRLRLAQRQEFFCPYCAERPKLRATDLFSPAETEIDHVIERRMGGDGPDNLVLAHKDCNNAKG

KKTPHEHAGDLLDSPALAALWQGWRKENADRLKGKGHKARTPREDKDFMDRVGWRFEEDARAKA

EENQERRGRRMLHDTARATRLARLYLAAAVMPEDPAEIGAPPVETPPSPEDPTGYTAIYRTISR

VQPVNGSVTHMLRQRLLQRDKNRDYQTHHAEDACLLLLAGPAVVQAFNTEAAQHGADAPDDRPV

DLMPTSDAYHQQRRARALGRVPLATVDAALADIVMPESDRQDPETGRVHWRLTRAGRGLKRRID

DLTRNCVILSRPRRPSETGTPGALHNATHYGRREITVDGRTDTVVTQRMNARDLVALLDNAKIV

PAARLDAAAPGDTILKEICTEIADRHDRVVDPEGTHARRWISARLAALVPAHAEAVARDIAELA

DLDALADADRTPEQEARRSALRQSPYLGRAISAKKADGRARAREQEILTRALLDPHWGPRGLRH

LIMREARAPSLVRIRANKTDAFGRPVPDAAVWVKTDGNAVSQLWRLTSVVTDDGRRIPLPKPIE

KRIEISNLEYARLNGLDEGAGVTGNNAPPRPLRQDIDRLTPLWRDHGTAPGGYLGTAVGELEDK

ARSALRGKAMRQTLTDAGITAEAGWRLDSEGAVCDLEVAKGDTVKKDGKTYKVGVITQGIFGMP

VDAAGSAPRTPEDCEKFEEQYGIKPWKAKGIPLA

SEQ ID NO: 343

MNYTEKEKLFMKYILALDIGIASVGWAILDKESETVIEAGSNIFPEASAADNQLRRDMRGAKRN

NRRLKTRINDFIKLWENNNLSIPQFKSTEIVGLKVRAITEEITLDELYLILYSYLKHRGISYLE

DALDDTVSGSSAYANGLKLNAKELETHYPCEIQQERLNTIGKYRGQSQIINENGEVLDLSNVFT

IGAYRKEIQRVFEIQKKYHPELTDEFCDGYMLIFNRKRKYYEGPGNEKSRTDYGRFTTKLDANG

NYITEDNIFEKLIGKCSVYPDELRAAAASYTAQEYNVLNDLNNLTINGRKLEENEKHEIVERIK

SSNTINMRKIISDCMGENIDDFAGARIDKSGKEIFHKFEVYNKMRKALLEIGIDISNYSREELD

EIGYIMTINTDKEAMMEAFQKSWIDLSDDVKQCLINMRKTNGALFNKWQSFSLKIMNELIPEMY

AQPKEQMTLLTEMGVTKGTQEEFAGLKYIPVDVVSEDIFNPVVRRSVRISFKILNAVLKKYKAL

DTIVIEMPRDRNSEEQKKRINDSQKLNEKEMEYIEKKLAVTYGIKLSPSDFSSQKQLSLKLKLW

NEQDGICLYSGKTIDPNDIINNPQLFEIDHIIPRSISFDDARSNKVLVYRSENQKKGNQTPYYY

LTHSHSEWSFEQYKATVMNLSKKKEYAISRKKIQNLLYSEDITKMDVLKGFINRNINDTSYASR

LVLNTIQNFFMANEADTKVKVIKGSYTHQMRCNLKLDKNRDESYSHHAVDAMLIGYSELGYEAY

HKLQGEFIDFETGEILRKDMWDENMSDEVYADYLYGKKWANIRNEVVKAEKNVKYWHYVMRKSN

RGLCNQTIRGTREYDGKQYKINKLDIRTKEGIKVFAKLAFSKKDSDRERLLVYLNDRRTFDDLC

KIYEDYSDAANPFVQYEKETGDIIRKYSKKHNGPRIDKLKYKDGEVGACIDISHKYGFEKGSKK

VILESLVPYRMDVYYKEENHSYYLVGVKQSDIKFEKGRNVIDEEAYARILVNEKMIQPGQSRAD

LENLGFKFKLSFYKNDIIEYEKDGKIYTERLVSRTMPKQRNYIETKPIDKAKFEKQNLVGLGKT

KFIKKYRYDILGNKYSCSEEKFTSFC

SEQ ID NO: 344

MLRLYCANNLVLNNVQNLWKYLLLLIFDKKIIFLFKIKVILIRRYMENNNKEKIVIGFDLGVAS

VGWSIVNAETKEVIDLGVRLFSEPEKADYRRAKRTTRRLLRRKKFKREKFHKLILKNAEIFGLQ

SRNEILNVYKDQSSKYRNILKLKINALKEEIKPSELVWILRDYLQNRGYFYKNEKLTDEFVSNS

FPSKKLHEHYEKYGFFRGSVKLDNKLDNKKDKAKEKDEEEESDAKKESEELIFSNKQWINEIVK

VFENQSYLTESFKEEYLKLFNYVRPFNKGPGSKNSRTAYGVFSTDIDPETNKFKDYSNIWDKTI

GKCSLFEEEIRAPKNLPSALIFNLQNEICTIKNEFTEFKNWWLNAEQKSEILKFVFTELFNWKD

KKYSDKKFNKNLQDKIKKYLLNFALENFNLNEEILKNRDLENDTVLGLKGVKYYEKSNATADAA

LEFSSLKPLYVFIKFLKEKKLDLNYLLGLENTEILYFLDSIYLAISYSSDLKERNEWFKKLLKE

-continued

LYPKIKNNNLEIIENVEDIFEITDQEKFESFSKTHSLSREAFNHIIPLLLSNNEGKNYESLKHS

NEELKKRTEKAELKAQQNQKYLKDNFLKEALVPLSVKTSVLQAIKIFNQIIKNFGKKYEISQVV

IEMARELTKPNLEKLLNNATNSNIKILKEKLDQTEKFDDFTKKKFIDKIENSVVFRNKLFLWFE

QDRKDPYTQLDIKINEIEDETEIDHVIPYSKSADDSWFNKLLVKKSTNQLKKNKTVWEYYQNES

DPEAKWNKFVAWAKRIYLVQKSDKESKDNSEKNSIFKNKKPNLKFKNITKKLFDPYKDLGFLAR

NLNDTRYATKVFRDQLNNYSKHHSKDDENKLFKVVCMNGSITSFLRKSMWRKNEEQVYRFNFWK

KDRDQFFHHAVDASIIAIFSLLTKTLYNKLRVYESYDVQRREDGVYLINKETGEVKKADKDYWK

DQHNFLKIRENAIEIKNVLNNVDFQNQVRYSRKANTKLNTQLFNETLYGVKEFENNFYKLEKVN

LFSRKDLRKFILEDLNEESEKNKKNENGSRKRILTEKYIVDEILQILENEEFKDSKSDINALNK

YMDSLPSKFSEFFSQDFINKCKKENSLILTFDAIKHNDPKKVIKIKNLKFFREDATLKNKQAVH

KDSKNQIKSFYESYKCVGFIWLKNKNDLEESIFVPINSRVIHFGDKDKDIFDFDSYNKEKLLNE

INLKRPENKKFNSINEIEFVKFVKPGALLLNFENQQIYYISTLESSSLRAKIKLLNKMDKGKAV

SMKKITNPDEYKIIEHVNPLGINLNWTKKLENNN

SEQ ID NO: 345
MLMSKHVLGLDLGVGSIGWCLIALDAQGDPAEILGMGSRVVPLNNATKAIEAFNAGAAFTASQE

RTARRTMRRGFARYQLRRYRLRRELEKVGMLPDAALIQLPLLELWELRERAATAGRRLTLPELG

RVLCHINQKRGYRHVKSDAAAIVGDEGEKKKDSNSAYLAGIRANDEKLQAEHKTVGQYFAEQLR

QNQSESPTGGISYRIKDQIFSRQCYIDEYDQIMAVQRVHYPDILTDEFIRMLRDEVIFMQRPLK

SCKHLVSLCEFEKQERVMRVQQDDGKGGWQLVERRVKFGPKVAPKSSPLFQLCCIYEAVNNIRL

TRPNGSPCDITPEERAKIVAHLQSSASLSFAALKKLLKEKALIADQLTSKSGLKGNSTRVALAS

ALQPYPQYHHLLDMELETRMMTVQLTDEETGEVTEREVAVVTDSYVRKPLYRLWHILYSIEERE

AMRRALITQLGMKEEDLDGGLLDQLYRLDFVKPGYGNKSAKFICKLLPQLQQGLGYSEACAAVG

YRHSNSPTSEEITERTLLEKIPLLQRNELRQPLVEKILNQMINLVNALKAEYGIDEVRVELARE

LKMSREERERMARNNKDREERNKGVAAKIRECGLYPTKPRIQKYMLWKEAGRQCLYCGRSIEEE

QCLREGGMEVEHIIPKSVLYDDSYGNKTCACRRCNKEKGNRTALEYIRAKGREAEYMKRINDLL

KEKKISYSKHQRLRWLKEDIPSDFLERQLRLTQYISRQAMAILQQGIRRVSASEGGVTARLRSL

WGYGKILHTLNLDRYDSMGETERVSREGEATEELHITNWSKRMDHRHHAIDALVVACTRQSYIQ

RLNRLSSEFGREDKKKEDQEAQEQQATETGRLSNLERWLTQRPHFSVRTVSDKVAEILISYRPG

QRVVTRGRNIYRKKMADGREVSCVQRGVLVPRGELMEASFYGKILSQGRVRIVKRYPLHDLKGE

VVDPHLRELITTYNQELKSREKGAPIPPLCLDKDKKQEVRSVRCYAKTLSLDKAIPMCFDEKGE

PTAFVKSASNHHLALYRTPKGKLVESIVTFWDAVDRARYGIPLVITHPREVMEQVLQRGDIPEQ

VLSLLPPSDWVFVDSLQQDEMVVIGLSDEELQRALEAQNYRKISEHLYRVQKMSSSYYVFRYHL

ETSVADDKNTSGRIPKFHRVQSLKAYEERNIRKVRVDLLGRISLL

SEQ ID NO: 346
MSDLVLGLDIGIGSVGVGILNKVTGEIIHKNSRIFPAAQAENNLVRRTNRQGRRLARRKKHRRV

RLNRLFEESGLITDFTKISINLNPYQLRVKGLTDELSNEELFIALKNMVKHRGISYLDDASDDG

NSSVGDYAQIVKENSKQLETKTPGQIQLERYQTYGQLRGDFTVEKDGKKHRLINVFPTSAYRSE

ALRILQTQQEFNPQITDEFINRYLEILTGKRKYYHGPGNEKSRTDYGRYRTSGETLDNIFGILI

GKCTFYPDEFRAAKASYTAQEFNLLNDLNNLTVPTETKKLSKEQKNQIINYVKNEKAMGPAKLF

KYIAKLLSCDVADIKGYRIDKSGKAEIHTFEAYRKMKTLETLDIEQMDRETLDKLAYVLTLNTE

REGIQEALEHEFADGSFSQKQVDELVQFRKANSSIFGKGWHNFSVKLMMELIPELYETSEEQMT

-continued

ILTRLGKQKTTSSSNKTKYIDEKLLTEEIYNPVVAKSVRQAIKIVNAAIKEYGDFDNIVIEMAR

ETNEDDEKKAIQKIQKANKDEKDAAMLKAANQYNGKAELPHSVFHGHKQLATKIRLWHQQGERC

LYTGKTISIHDLINNSNQFEVDHILPLSITFDDSLANKVLVYATANQEKGQRTPYQALDSMDDA

WSFRELKAFVRESKTLSNKKKEYLLTEEDISKFDVRKKFIERNLVDTRYASRVVLNALQEHFRA

HKIDTKVSVVRGQFTSQLRRHWGIEKTRDTYHHHAVDALIIAASSQLNLWKKQKNTLVSYSEDQ

LLDIETGELISDDEYKESVFKAPYQHFVDTLKSKEFEDSILFSYQVDSKFNRKISDATIYATRQ

AKVGKDKADETYVLGKIKDIYTQDGYDAFMKIYKKDKSKFLMYRHDPQTFEKVIEPILENYPNK

QINEKGKEVPCNPFLKYKEEHGYIRKYSKKGNGPEIKSLKYYDSKLGNHIDITPKDSNNKVVLQ

SVSPWRADVYFNKTTGKYEILGLKYADLQFEKGTGTYKISQEKYNDIKKKEGVDSDSEFKFTLY

KNDLLLVKDTETKEQQLFRFLSRTMPKQKHYVELKPYDKQKFEGGEALIKVLGNVANSGQCKKG

LGKSNISIYKVRTDVLGNQHIIKNEGDKPKLDF

SEQ ID NO: 347
MNAEHGKEGLLIMEENFQYRIGLDIGITSVGWAVLQNNSQDEPVRITDLGVRIFDVAENPKNGD

ALAAPRRDARTTRRRLRRRRHRLERIKFLLQENGLIEMDSFMERYYKGNLPDVYQLRYEGLDRK

LKDEELAQVLIHIAKHRGFRSTRKAETKEKEGGAVLKATTENQKIMQEKGYRTVGEMLYLDEAF

HTECLWNEKGYVLTPRNRPDDYKHTILRSMLVEEVHAIFAAQRAHGNQKATEGLEEAYVEIMTS

QRSFDMGPGLQPDGKPSPYAMEGFGDRVGKCTFEKDEYRAPKATYTAELFVALQKINHTKLIDE

FGTGRFFSEEERKTIIGLLLSSKELKYGTIRKKLNIDPSLKFNSLNYSAKKEGETEEERVLDTE

KAKFASMFWTYEYSKCLKDRTEEMPVGEKADLFDRIGEILTAYKNDDSRSSRLKELGLSGEEID

GLLDLSPAKYQRVSLKAMRKMQPYLEDGLIYDKACEAAGYDFRALNDGNKKHLLKGEEINAIVN

DITNPVVKRSVSQTIKVINAIIQKYGSPQAVNIELAREMSKNFQDRTNLEKEMKKRQQENERAK

QQIIELGKQNPTGQDILKYRLWNDQGGYCLYSGKKIPLEELFDGGYDIDHILPYSITFDDSYRN

KVLVTAQENRQKGNRTPYEYFGADEKRWEDYEASVRLLVRDYKKQQKLLKKNFTEEERKEFKER

NLNDTKYITRVVYNMIRQNLELEPFNHPEKKKQVWAVNGAVTSYLRKRWGLMQKDRSTDRHHAM

DAVVIACCTDGMIHKISRYMQGRELAYSRNFKFPDEETGEILNRDNFTREQWDEKFGVKVPLPW

NSFRDELDIRLLNEDPKNFLLTHADVQRELDYPGWMYGEEESPIEEGRYINYIRPLFVSRMPNH

KVTGSAHDATIRSARDYETRGVVITKVPLTDLKLNKDNEIEGYYDKDSDRLLYQALVRQLLLHG

NDGKKAFAEDFHKPKADGTEGPVVRKVKIEKKQTSGVMVRGGTGIAANGEMVRIDVFRENGKYY

FVPVYTADVVRKVLPNRAATHTKPYSEWRVMDDANFVFSLYSRDLIHVKSKKDIKTNLVNGGLL

LQKEIFAYYTGADIATASIAGFANDSNFKFRGLGIQSLEIFEKCQVDILGNISVVRHENRQEFH

SEQ ID NO: 348
MRVLGLDAGIASLGWALIEIEESNRGELSQGTIIGAGTWMFDAPEEKTQAGAKLKSEQRRTFRG

QRRVVRRRRQRMNEVRRILHSHGLLPSSDRDALKQPGLDPWRIRAEALDRLLGPVELAVALGHI

ARHRGFKSNSKGAKTNDPADDTSKMKRAVNETREKLARFGSAAKMLVEDESFVLRQTPTKNGAS

EIVRRFRNREGDYSRSLLRDDLAAEMRALFTAQARFQSAIATADLQTAFTKAAFFQRPLQDSEK

LVGPCPFEVDEKRAPKRGYSFELFRFLSRLNHVTLRDGKQERTLTRDELALAAADFGAAAKVSF

TALRKKLKLPETTVFVGVKADEESKLDVVARSGKAAEGTARLRSVIVDALGELAWGALLCSPEK

LDKIAEVISFRSDIGRISEGLAQAGCNAPLVDALTAAASDGRFDPFTGAGHISSKAARNILSGL

RQGMTYDKACCAADYDHTASRERGAFDVGGHGREALKRILQEERISRELVGSPTARKALIESIK

QVKAIVERYGVPDRIHVELARDVGKSIEEREEITRGIEKRNRQKDKLRGLFEKEVGRPPQDGAR

GKEELLRFELWSEQMGRCLYTDDYISPSQLVATDDAVQVDHILPWSRFADDSYANKTLCMAKAN

QDKKGRTPYEWFKAEKTDTEWDAFIVRVEALADMKGFKKRNYKLRNAEEAAAKFRNRNLNDTRW

```
ACRLLAEALKQLYPKGEKDKDGKERRRVFSRPGALTDRLRRAWGLQWMKKSTKGDRIPDDRHHA
LDAIVIAATTESLLQRATREVQEIEDKGLHYDLVKNVTPPWPGFREQAVEAVEKVFVARAERRR
ARGKAHDATIRHIAVREGEQRVYERRKVAELKLADLDRVKDAERNARLIEKLRNWIEAGSPKDD
PPLSPKGDPIFKVRLVTKSKVNIALDTGNPKRPGTVDRGEMARVDVFRKASKKGKYEYYLVPIY
PHDIATMKTPPIRAVQAYKPEDEWPEMDSSYEFCWSLVPMTYLQVISSKGEIFEGYYRGMNRSV
GAIQLSAHSNSSDVVQGIGARTLTEFKKFNVDRFGRKHEVERELRTWRGETWRGKAYI

SEQ ID NO: 349
MGNYYLGLDVGIGSIGWAVINIEKKRIEDFNVRIFKSGEIQEKNRNSRASQQCRRSRGLRRLYR
RKSHRKLRLKNYLSIIGLTTSEKIDYYYETADNNVIQLRNKGLSEKLTPEEIAACLIHICNNRG
YKDFYEVNVEDIEDPDERNEYKEEHDSIVLISNLMNEGGYCTPAEMICNCREFDEPNSVYRKFH
NSAASKNHYLITRHMLVKEVDLILENQSKYYGILDDKTIAKIKDIIFAQRDFEIGPGKNERFRR
FTGYLDSIGKCQFFKDQERGSRFTVIADIYAFVNVLSQYTYTNNRGESVFDTSFANDLINSALK
NGSMDKRELKAIAKSYHIDISDKNSDTSLTKCFKYIKVVKPLFEKYGYDWDKLIENYTDTDNNV
LNRIGIVLSQAQTPKRRREKLKALNIGLDDGLINELTKLKLSGTANVSYKYMQGSIEAFCEGDL
YGKYQAKFNKEIPDIDENAKPQKLPPFKNEDDCEFFKNPVVFRSINETRKLINAIIDKYGYPAA
VNIETADELNKTFEDRAIDTKRNNDNQKENDRIVKEIIECIKCDEVHARHLIEKYKLWEAQEGK
CLYSGETITKEDMLRDKDKLFEVDHIVPYSLILDNTINNKALVYAEENQKKGQRTPLMYMNEAQ
AADYRVRVNTMFKSKKCSKKKYQYLMLPDLNDQELLGGWRSRNLNDTRYICKYLVNYLRKNLRF
DRSYESSDEDDLKIRDHYRVFPVKSRFTSMFRRWWLNEKTWGRYDKAELKKLTYLDHAADAIII
ANCRPEYVVLAGEKLKLNKMYHQAGKRITPEYEQSKKACIDNLYKLFRMDRRTAEKLLSGHGRL
TPIIPNLSEEVDKRLWDKNIYEQFWKDDKDKKSCEELYRENVASLYKGDPKFASSLSMPVISLK
PDHKYRGTITGEEAIRVKEIDGKLIKLKRKSISEITAESINSIYTDDKILIDSLKTIFEQADYK
DVGDYLKKTNQHFFTTSSGKRVNKVTVIEKVPSRWLRKEIDDNNFSLLNDSSYYCIELYKDSKG
DNNLQGIAMSDIVHDRKTKKLYLKPDFNYPDDYYTHVMYIFPGDYLRIKSTSKKSGEQLKFEGY
FISVKNVNENSFRFISDNKPCAKDKRVSITKKDIVIKLAVDLMGKVQGENNGKGISCGEPLSLL
KEKN

SEQ ID NO: 350
MLSRQLLGASHLARPVSYSYNVQDNDVHCSYGERCFMRGKRYRIGIDVGLNSVGLAAVEVSDEN
SPVRLLNAQSVIHDGGVDPQKNKEAITRKNMSGVARRTRRMRRRKRERLHKLDMLLGKFGYPVI
EPESLDKPFEEWHVRAELATRYIEDDELRRESISIALRHMARHRGWRNPYRQVDSLISDNPYSK
QYGELKEKAKAYNDDATAAEEESTPAQLVVAMLDAGYAEAPRLRWRTGSKKPDAEGYLPVRLMQ
EDNANELKQIFRVQRVPADEWKPLFRSVFYAVSPKGSAEQRVGQDPLAPEQARALKASLAFQEY
RIANVITNLRIKDASAELRKLTVDEKQSIYDQLVSPSSEDITWSDLCDFLGFKRSQLKGVGSLT
EDGEERISSRPPRLTSVQRIYESDNKIRKPLVAWWKSASDNEHEAMIRLLSNTVDIDKVREDVA
YASAIEFIDGLDDDALTKLDSVDLPSGRAAYSVETLQKLTRQMLTTDDDLHEARKTLFNVTDSW
RPPADPIGEPLGNPSVDRVLKNVNRYLMNCQQRWGNPVSVNIEHVRSSFSSVAFARKDKREYEK
NNEKRSIFRSSLSEQLRADEQMEKVRESDLRRLEAIQRQNGQCLYCGRTITFRTCEMDHIVPRK
GVGSTNTRTNFAAVCAECNRMKSNTPFAIWARSEDAQTRGVSLAEAKKRVTMFTFNPKSYAPRE
VKAFKQAVIARLQQTEDDAAIDNRSIESVAWMADELHRRIDWYFNAKQYVNSASIDDAEAETMK
TTVSVFQGRVTASARRAAGIEGKIHFIGQQSKTRLDRRHHAVDASVIAMMNTAAAQTLMERESL
RESQRLIGLMPGERSWKEYPYEGTSRYESFHLWLDNMDVLLELLNDALDNDRIAVMQSQRYVLG
```

-continued

NSIAHDATIHPLEKVPLGSAMSADLIRRASTPALWCALTRLPDYDEKEGLPEDSHREIRVHDTR

YSADDEMGFFASQAAQIAVQEGSADIGSAIHHARVYRCWKTNAKGVRKYFYGMIRVFQTDLLRA

CHDDLFTVPLPPQSISMRYGEPRVVQALQSGNAQYLGSLVVGDEIEMDFSSLDVDGQIGEYLQF

FSQFSGGNLAWKHWVVDGFFNQTQLRIRPRYLAAEGLAKAFSDDVVPDGVQKIVTKQGWLPPVN

TASKTAVRIVRRNAFGEPRLSSAHHMPCSWQWRHE

SEQ ID NO: 351
MYSIGLDLGISSVGWSVIDERTGNVIDLGVRLFSAKNSEKNLERRTNRGGRRLIRRKTNRLKDA

KKILAAVGFYEDKSLKNSCPYQLRVKGLTEPLSRGEIYKVTLHILKKRGISYLDEVDTEAAKES

QDYKEQVRKNAQLLTKYTPGQIQLQRLKENNRVKTGINAQGNYQLNVFKVSAYANELATILKTQ

QAFYPNELTDDWIALFVQPGIAEEEAGLIYRKRPYYHGPGNEANNSPYGRWSDFQKTGEPATNIF

DKLIGKDFQGELRASGLSLSAQQYNLLNDLTNLKIDGEVPLSSEQKEYILTELMTKEFTRFGVN

DVVKLLGVKKERLSGWRLDKKGKPEIHTLKGYRNWRKIFAEAGIDLATLPTETIDCLAKVLTLN

TEREGIENTLAFELPELSESVKLLVLDRYKELSQSISTQSWHRFSLKTLHLLIPELMNATSEQN

TLLEQFQLKSDVRKRYSEYKKLPTKDVLAEIYNPTVNKTVSQAFKVIDALLVKYGKEQIRYITI

EMPRDDNEEDEKKRIKELHAKNSQRKNDSQSYFMQKSGWSQEKFQTTIQKNRRFLAKLLYYYEQ

DGICAYTGLPISPELLVSDSTEIDHIIPISISLDDSINNKVLVLSKANQVKGQQTPYDAWMDGS

FKKINGKFSNWDDYQKWVESRHFSHKKENNLLETRNIFDSEQVEKFLARNLNDTRYASRLVLNT

LQSFFTNQETKVRVVNGSFTHTLRKKWGADLDKTRETHHHHAVDATLCAVTSFVKVSRYHYAVK

EETGEKVMREIDFETGEIVNEMSYWEFKKSKKYERKTYQVKWPNFREQLKPVNLHPRIKFSHQV

DRKANRKLSDATIYSVREKTEVKTLKSGKQKITTDEYTIGKIKDIYTLDGWEAFKKKQDKLLMK

DLDEKTYERLLSIAETTPDFQEVEEKNGKVKRVKRSPFAVYCEENDIPAIQKYAKKNNGPLIRS

LKYYDGKLNKHINITKDSQGRPVEKTKNGRKVTLQSLKPYRYDIYQDLETKAYYTVQLYYSDLR

FVEGKYGITEKEYMKKVAEQTKGQVVRFCFSLQKNDGLEIEWKDSQRYDVRFYNFQSANSINFK

GLEQEMMPAENQFKQKPYNNGAINLNIAKYGKEGKKLRKFNTDILGKKHYLFYEKEPKNIIK

SEQ ID NO: 352
MYFYKNKENKLNKKVVLGLDLGIASVGWCLTDISQKEDNKFPIILHGVRLFETVDDSDDKLLNE

TRRKKRGQRRRNRRLFTRKRDFIKYLIDNNIIELEFDKNPKILVRNFIEKYINPFSKNLELKYK

SVTNLPIGFHNLRKAAINEKYKLDKSELIVLLYFYLSLRGAFFDNPEDTKSKEMNKNEIEIFDK

NESIKNAEFPIDKIIEFYKISGKIRSTINLKFGHQDYLKEIKQVFEKQNIDFMNYEKFAMEEKS

FFSRIRNYSEGPGNEKSFSKYGLYANENGNPELIINEKGQKIYTKIFKTLWESKIGKCSYDKKL

YRAPKNSFSAKVFDITNKLTDWKHKNEYISERLKRKILLSRFLNKDSKSAVEKILKEENIKFEN

LSEIAYNKDDNKINLPIINAYHSLTTIFKKHLINFENYLISNENDLSKLMSFYKQQSEKLFVPN

EKGSYEINQNNNVLHIFDAISNILNKFSTIQDRIRILEGYFEFSNLKKDVKSSEIYSEIAKLRE

FSGTSSLSFGAYYKFIPNLISEGSKNYSTISYEEKALQNQKNNFSHSNLFEKTWVEDLIASPTV

KRSLRQTMNLLKEIFKYSEKNNLEIEKIVVEVTRSSNNKHERKKIEGINKYRKEKYEELKKVYD

LPNENTTLLKKLWLLRQQQGYDAYSLRKIEANDVINKPWNYDIDHIVPRSISFDDSFSNLVIVN

KLDNAKKSNDLSAKQFIEKIYGIEKLKEAKENWGNWYLRNANGKAFNDKGKFIKLYTIDNLDEF

DNSDFINRNLSDTSYITNALVNHLTFSNSKYKYSVVSVNGKQTSNLRNQIAFVGIKNNKETERE

WKRPEGFKSINSNDFLIREEGKNDVKDDVLIKDRSFNGHHAEDAYFITIISQYFRSFKRIERLN

VNYRKETRELDDLEKNNIKFKEKASFDNFLLINALDELNEKLNQMRFSRMVITKKNTQLFNETL

YSGKYDKGKNTIKKVEKLNLLDNRTDKIKKIEEFFDEDKLKENELTKLHIFNHDKNLYETLKII

WNEVKIEIKNKNLNEKNYFKYFVNKKLQEGKISFNEWVPILDNDFKIIRKIRYIKFSSEEKETD

-continued

EIIFSQSNFLKIDQRQNFSFHNTLYWVQIWVYKNQKDQYCFISIDARNSKFEKDEIKINYEKLK

TQKEKLQIINEEPILKINKGDLFENEEKELFYIVGRDEKPQKLEIKYILGKKIKDQKQIQKPVK

KYFPNWKKVNLTYMGEIFKK

SEQ ID NO: 353

MDNKNYRIGIDVGLNSIGFCAVEVDQHDTPLGFLNLSVYRHDAGIDPNGKKTNTTRLAMSGVAR

RTRRLFRKRKRRLAALDRFIEAQGWTLPDHADYKDPYTPWLVRAELAQTPIRDENDLHEKLAIA

VRHIARHRGWRSPWVPVRSLHVEQPPSDQYLALKERVEAKTLLQMPEGATPAEMVVALDLSVDV

NLRPKNREKTDTRPENKKPGFLGGKLMQSDNANELRKIAKIQGLDDALLRELIELVFAADSPKG

ASGELVGYDVLPGQHGKRRAEKAHPAFQRYRIASIVSNLRIRHLGSGADERLDVETQKRVFEYL

LNAKPTADITWSDVAEEIGVERNLLMGTATQTADGERASAKPPVDVTNVAFATCKIKPLKEWWL

NADYEARCVMVSALSHAEKLTEGTAAEVEVAEFLQNLSDEDNEKLDSFSLPIGRAAYSVDSLER

LTKRMIENGEDLFEARVNEFGVSEDWRPPAEPIGARVGNPAVDRVLKAVNRYLMAAEAEWGAPL

SVNIEHVREGFISKRQAVEIDRENQKRYQRNQAVRSQIADHINATSGVRGSDVTRYLAIQRQNG

ECLYCGTAITFVNSEMDHIVPRAGLGSTNTRDNLVATCERCNKSKSNKPFAVWAAECGIPGVSV

AEALKRVDFWIADGFASSKEHRELQKGVKDRLKRKVSDPEIDNRSMESVAWMARELAHRVQYYF

DEKHTGTKVRVFRGSLTSAARKASGFESRVNFIGGNGKTRLDRRHHAMDAATVAMLRNSVAKTL

VLRGNIRASERAIGAAETWKSFRGENVADRQIFESWSENMRVLVEKFNLALYNDEVSIFSSLRL

QLGNGKAHDDTITKLQMHKVGDAWSLTEIDRASTPALWCALTRQPDFTWKDGLPANEDRTIIVN

GTHYGPLDKVGIFGKAAASLLVRGGSVDIGSAIHHARIYRIAGKKPTYGMVRVFAPDLLRYRNE

DLFNVELPPQSVSMRYAEPKVREAIREGKAEYLGWLVVGDELLLDLSSETSGQIAELQQDFPGT

THWTVAGFFSPSRLRLRPVYLAQEGLGEDVSEGSKSIIAGQGWRPAVNKVFGSAMPEVIRRDGL

GRKRRFSYSGLPVSWQG

SEQ ID NO: 354

MRLGLDIGTSSIGWWLYETDGAGSDARITGVVDGGVRIFSDGRDPKSGASLAVDRRAARAMRRR

RDRYLRRRATLMKVLAETGLMPADPAEAKALEALDPFALRAAGLDEPLPLPHLGRALFHLNQRR

GFKSNRKTDRGDNESGKIKDATARLDMEMMANGARTYGEFLHKRRQKATDPRHVPSVRTRLSIA

NRGGPDGKEEAGYDFYPDRRHLEEEFHKLWAAQGAHHPELTETLRDLLFEKIFFQRPLKEPEVG

LCLFSGHHGVPPKDPRLPKAHPLTQRRVLYETVNQLRVTADGREARPLTREERDQVIHALDNKK

PTKSLSSMVLKLPALAKVLKLRDGERFTLETGVRDAIACDPLRASPAHPDRFGPRWSILDADAQ

WEVISRIRRVQSDAEHAALVDWLTEAHGLDRAHAEATAHAPLPDGYGRLGLTATTRILYQLTAD

VVTYADAVKACGWHHSDGRTGECFDRLPYYGEVLERHVIPGSYHPDDDDITRFGRITNPTVHIG

LNQLRRLVNRIIETHGKPHQIVVELARDLKKSEEQKRADIKRIRDTTEAAKKRSEKLEELEIED

NGRNRMLLRLWEDLNPDDAMRRFCPYTGTRISAAMIFDGSCDVDHILPYSRTLDDSFPNRTLCL

REANRQKRNQTPWQAWGDTPHWHAIAANLKNLPENKRWRFAPDAMTRFEGENGFLDRALKDTQY

LARISRSYLDTLFTKGGHVWVVPGRFTEMLRRHWGLNSLLSDAGRGAVKAKNRTDHRHHAIDAA

VIAATDPGLLNRISRAAGQGEAAGQSAELIARDTPPPWEGFRDDLRVRLDRIIVSHRADHGRID

HAARKQGRDSTAGQLHQETAYSIVDDIHVASRTDLLSLKPAQLLDEPGRSGQVRDPQLRKALRV

ATGGKTGKDFENALRYFASKPGPYQAIRRVRIIKPLQAQARVPVPAQDPIKAYQGGSNHLFEIW

RLPDGEIEAQVITSFEAHTLEGEKRPHPAAKRLLRVHKGDMVALERDGRRVVGHVQKMDIANGL

FIVPHNEANADTRNNDKSDPFKWIQIGARPAIASGIRRVSVDEIGRLRDGGTRPI

SEQ ID NO: 355

MLHCIAVIRVPPSEEPGFFETHADSCALCHHGCMTYAANDKAIRYRVGIDVGLRSIGFCAVEVD
DEDHPIRILNSVVHVHDAGTGGPGETESLRKRSGVAARARRRGRAEKQRLKKLDVLLEELGWGV
SSNELLDSHAPWHIRKRLVSEYIEDETERRQCLSVAMAHIARHRGWRNSFSKVDTLLLEQAPSD
RMQGLKERVEDRTGLQFSEEVTQGELVATLLEHDGDVTIRGFVRKGGKATKVHGVLEGKYMQSD
LVAELRQICRTQRVSETTFEKLVLSIFHSKEPAPSAARQRERVGLDELQLALDPAAKQPRAERA
HPAFQKFKVVATLANMRIREQSAGERSLTSEELNRVARYLLNHTESESPTWDDVARKLEVPRHR
LRGSSRASLETGGGLTYPPVDDTTVRVMSAEVDWLADWWDCANDESRGHMIDAISNGCGSEPDD
VEDEEVNELISSATAEDMLKLELLAKKLPSGRVAYSLKTLREVTAAILETGDDLSQAITRLYGV
DPGWVPTPAPIEAPVGNPSVDRVLKQVARWLKFASKRWGVPQTVNIEHTREGLKSASLLEEERE
RWERFEARREIRQKEMYKRLGISGPFRRSDQVRYEILDLQDCACLYCGNEINFQTFEVDHIIPR
VDASSDSRRTNLAAVCHSCNSAKGGLAFGQWVKRGDCPSGVSLENAIKRVRSWSKDRLGLTEKA
MGKRKSEVISRLKTEMPYEEFDGRSMESVAWMAIELKKRIEGYFNSDRPEGCAAVQVNAYSGRL
TACARRAAHVDKRVRLIRLKGDDGHHKNRFDRRNHAMDALVIALMTPAIARTIAVREDRREAQQ
LTRAFESWKNFLGSEERMQDRWESWIGDVEYACDRLNELIDADKIPVTENLRLRNSGKLHADQP
ESLKKARRGSKRPRPQRYVLGDALPADVINRVTDPGLWTALVRAPGFDSQLGLPADLNRGLKLR
GKRISADFPIDYFPTDSPALAVQGGYVGLEFHHARLYRIIGPKEKVKYALLRVCAIDLCGIDCD
DLFEVELKPSSISMRTADAKLKEAMGNGSAKQIGWLVLGDEIQIDPTKFPKQSIGKFLKECGPV
SSWRVSALDTPSKITLKPRLLSNEPLLKTSRVGGHESDLVVAECVEKIMKKTGWVVEINALCQS
GLIRVIRRNALGEVRTSPKSGLPISLNLR

SEQ ID NO: 356

MRYRVGLDLGTASVGAAVFSMDEQGNPMELIWHYERLFSEPLVPDMGQLKPKKAARRLARQQRR
QIDRRASRLRRIAIVSRRLGIAPGRNDSGVHGNDVPTLRAMAVNERIELGQLRAVLLRMGKKRG
YGGTFKAVRKVGEAGEVASGASRLEEEMVALASVQNKDSVTVGEYLAARVEHGLPSKLKVAANN
EYYAPEYALFRQYLGLPAIKGRPDCLPNMYALRHQIEHEFERIWATQSQFHDVMKDHGVKEEIR
NAIFFQRPLKSPADKVGRCSLQTNLPRAPRAQIAAQNFRIEKQMADLRWGMGRRAEMLNDHQKA
VIRELLNQQKELSFRKIYKELERAGCPGPEGKGLNMDRAALGGRDDLSGNTTLAAWRKLGLEDR
WQELDEVTQIQVINFLADLGSPEQLDTDDWSCRFMGKNGRPRNFSDEFVAFMNELRMTDGFDRL
SKMGFEGGRSSYSIKALKALTEWMIAPHWRETPETHRVDEEAAIRECYPESLATPAQGGRQSKL
EPPPLTGNEVVDVALRQVRHTINMMIDDLGSVPAQIVVEMAREMKGGVTRRNDIEKQNKRFASE
RKKAAQSIEENGKTPTPARILRYQLWIEQGHQCPYCESNISLEQALSGAYTNFEHILPRTLTQI
GRKRSELVLAHRECNDEKGNRTPYQAFGHDDRRWRIVEQRANALPKKSSRKTRLLLLKDFEGEA
LTDESIDEFADRQLHESSWLAKVTTQWLSSLGSDVYVSRGSLTAELRRRWGLDTVIPQVRFESG
MPVVDEEGAEITPEEFEKFRLQWEGHRVTREMRTDRRPDKRIDHRHHLVDAIVTALTSRSLYQQ
YAKAWKVADEKQRHGRVDVKVELPMPILTIRDIALEAVRSVRISHKPDRYPDGRFFEATAYGIA
QRLDERSGEKVDWLVSRKSLTDLAPEKKSIDVDKVRANISRIVGEAIRLHISNIFEKRVSKGMT
PQQALREPIEFQGNILRKVRCFYSKADDCVRIEHSSRRGHHYKMLLNDGFAYMEVPCKEGILYG
VPNLVRPSEAVGIKRAPESGDFIRFYKGDTVKNIKTGRVYTIKQILGDGGGKLILTPVTETKPA
DLLSAKWGRLKVGGRNIHLLRLCAE

SEQ ID NO: 357

MIGEHVRGGCLFDDHWTPNWGAFRLPNTVRTFTKAENPKDGSSLAEPRRQARGLRRRLRRKTQR
LEDLRRLLAKEGVLSLSDLETLFRETPAKDPYQLRAEGLDRPLSFPEWVRVLYHITKHRGFQSN

-continued

```
RRNPVEDGQERSRQEEEGKLLSGVGENERLLREGGYRTAGEMLARDPKFQDHRRNRAGDYSHTL

SRSLLLEEARRLFQSQRTLGNPHASSNLEEAFLHLVAFQNPFASGEDIRNKAGHCSLEPDQIRA

PRRSASAETFMLLQKTGNLRLIHRRTGEERPLTDKEREQIHLLAWKQEKVTHKTLRRHLEIPEE

WLFTGLPYHRSGDKAEEKLFVHLAGIHEIRKALDKGPDPAVWDTLRSRRDLLDSIADTLTFYKN

EDEILPRLESLGLSPENARALAPLSFSGTAHLSLSALGKLLPHLEEGKSYTQARADAGYAAPPP

DRHPKLPPLEEADWRNPVVFRALTQTRKVVNALVRRYGPPWCIHLETARELSQPAKVRRRIETE

QQANEKKKQQAEREFLDIVGTAPGPGDLLKMRLWREQGGFCPYCEEYLNPTRLAEPGYAEMDHI

LPYSRSLDNGWHNRVLVHGKDNRDKGNRTPFEAFGGDTARWDRLVAWVQASHLSAPKKRNLLRE

DFGEEAERELKDRNLTDTRFITKTAATLLRDRLTFHPEAPKDPVMTLNGRLTAFLRKQWGLHKN

RKNGDLHHALDAAVLAVASRSFVYRLSSHNAAWGELPRGREAENGFSLPYPAFRSEVLARLCPT

REEILLRLDQGGVGYDEAFRNGLRPVFVSRAPSRRLRGKAHMETLRSPKWKDHPEGPRTASRIP

LKDLNLEKLERMVGKDRDRKLYEALRERLAAFGGNGKKAFVAPFRKPCRSGEGPLVRSLRIFDS

GYSGVELRDGGEVYAVADHESMVRVDVYAKKNRFYLVPVYVADVARGIVKNRAIVAHKSEEEWD

LVDGSFDFRFSLFPGDLVEIEKKDGAYLGYYKSCHRGDGRLLLDRHDRMPRESDCGTFYVSTRK

DVLSMSKYQVDPLGEIRLVGSEKPPFVL

SEQ ID NO: 358
MEKKRKVTLGFDLGIASVGWAIVDSETNQVYKLGSRLFDAPDTNLERRTQRGTRRLLRRRKYRN

QKFYNLVKRTEVFGLSSREAIENRFRELSIKYPNIIELKTKALSQEVCPDEIAWILHDYLKNRG

YFYDEKETKEDFDQQTVESMPSYKLNEFYKKYGYFKGALSQPTESEMKDNKDLKEAFFFDFSNK

EWLKEINYFFNVQKNILSETFIEEFKKIFSFTRDISKGPGSDNMPSPYGIFGEFGDNGQGGRYE

HIWDKNIGKCSIFTNEQRAPKYLPSALIFNFLNELANIRLYSTDKKNIQPLWKLSSVDKLNILL

NLFNLPISEKKKKLTSTNINDIVKKESIKSIMISVEDIDMIKDEWAGKEPNVYGVGLSGLNIEE

SAKENKFKFQDLKILNVLINLLDNVGIKFEFKDRNDIIKNLELLDNLYLFLIYQKESNNKDSSI

DLFIAKNESLNIENLKLKLKEFLLGAGNEFENHNSKTHSLSKKAIDEILPKLLDNNEGWNLEAI

KNYDEEIKSQIEDNSSLMAKQDKKYLNDNFLKDAILPPNVKVTFQQAILIFNKIIQKFSKDFEI

DKVVIELAREMTQDQENDALKGIAKAQKSKKSLVEERLEANNIDKSVFNDKYEKLIYKIFLWIS

QDFKDPYTGAQISVNEIVNNKVEIDHIIPYSLCFDDSSANKVLVHKQSNQEKSNSLPYEYIKQG

HSGWNWDEFTKYVKRVFVNNVDSILSKKERLKKSENLLTASYDGYDKLGFLARNLNDTRYATIL

FRDQLNNYAEHHLIDNKKMFKVIAMNGAVTSFIRKNMSYDNKLRLKDRSDFSHHAYDAAIIALF

SNKTKTLYNLIDPSLNGIISKRSEGYWVIEDRYTGEIKELKKEDWTSIKNNVQARKIAKEIEEY

LIDLDDEVFFSRKTKRKTNRQLYNETIYGIATKTDEDGITNYYKKEKFSILDDKDIYLRLLRER

EKFVINQSNPEVIDQIIEIIESYGKENNIPSRDEAINIKYTKNKINYNLYLKQYMRSLTKSLDQ

FSEEFINQMIANKTFVLYNPTKNTTRKIKFLRLVNDVKINDIRKNQVINKFNGKNNEPKAFYEN

INSLGAIVFKNSANNFKTLSINTQIAIFGDKNWDIEDFKTYNMEKIEKYKEIYGIDKTYNFHSF

IFPGTILLDKQNKEFYYISSIQTVRDIIEIKFLNKIEFKDENKNQDTSKTPKRLMFGIKSIMNN

YEQVDISPFGINKKIFE

SEQ ID NO: 359
MGYRIGLDVGITSTGYAVLKTDKNGLPYKILTLDSVIYPRAENPQTGASLAEPRRIKRGLRRRT

RRTKFRKQRTQQLFIHSGLLSKPEIEQILATPQAKYSVYELRVAGLDRRLTNSELFRVLYFFIG

HRGFKSNRKAELNPENEADKKQMGQLLNSIEEIRKAIAEKGYRTVGELYLKDPKYNDHKRNKGY

IDGYLSTPNRQMLVDEIKQILDKQRELGNEKLTDEFYATYLLGDENRAGIFQAQRDFDEGPGAG
```

-continued

PYAGDQIKKMVGKDIFEPTEDRAAKATYTFQYFNLLQKMTSLNYQNTTGDTWHTLNGLDRQAII

DAVFAKAEKPTKTYKPTDFGELRKLLKLPDDARFNLVNYGSLQTQKEIETVEKKTRFVDFKAYH

DLVKVLPEEMWQSRQLLDHIGTALTLYSSDKRRRYFAEELNLPAELIEKLLPLNFSKFGHLSI

KSMQNIIPYLEMGQVYSEATTNTGYDFRKKQISKDTIREEITNPVVRRAVTKTIKIVEQIIRRY

GKPDGINIELARELGRNFKERGDIQKRQDKNRQTNDKIAAELTELGIPVNGQNIIRYKLHKEQN

GVDPYTGDQIPFERAFSEGYEVDHIIPYSISWDDSYTNKVLTSAKCNREKGNRIPMVYLANNEQ

RLNALTNIADNIIRNSRKRQKLLKQKLSDEELKDWKQRNINDTRFITRVLYNYFRQAIEFNPEL

EKKQRVLPLNGEVTSKIRSRWGFLKVREDGDLHHAIDATVIAAITPKFIQQVTKYSQHQEVKNN

QALWHDAEIKDAEYAAEAQRMDADLFNKIFNGFPLPWPEFLDELLARISDNPVEMMKSRSWNTY

TPIEIAKLKPVFVVRLANHKISGPAHLDTIRSAKLFDEKGIVLSRVSITKLKINKKGQVATGDG

IYDPENSNNGDKVVYSAIRQALEAHNGSGELAFPDGYLEYVDHGTKKLVRKVRVAKKVSLPVRL

KNKAAADNGSMVRIDVFNTGKKFVFVPIYIKDTVEQVLPNKAIARGKSLWYQITESDQFCFSLY

PGDMVHIESKTGIKPKYSNKENNTSVVPIKNFYGYFDGADIATASILVRAHDSSYTARSIGIAG

LLKFEKYQVDYFGRYHKVHEKKRQLFVKRDE

SEQ ID NO: 360
MQKNINTKQNHIYIKQAQKIKEKLGDKPYRIGLDLGVGSIGFAIVSMEENDGNVLLPKEIIMVG

SRIFKASAGAADRKLSRGQRNNHRHTRERMRYLWKVLAEQKLALPVPADLDRKENSSEGETSAK

RFLGDVLQKDIYELRVKSLDERLSLQELGYVLYHIAGHRGSSAIRTFENDSEEAQKENTENKKI

AGNIKRLMAKKNYRTYGEYLYKEFFENKEKHKREKISNAANNHKFSPTRDLVIKEAEAILKKQA

GKDGFHKELTEEYIEKLTKAIGYESEKLIPESGFCPYLKDEKRLPASHKLNEERRLWETLNNAR

YSDPIVDIVTGEITGYYEKQFTKEQKQKLFDYLLTGSELTPAQTKKLLGLKNTNFEDIILQGRD

KKAQKIKGYKLIKLESMPFWARLSEAQQDSFLYDWNSCPDEKLLTEKLSNEYHLTEEEIDNAFN

EIVLSSSYAPLGKSAMLIILEKIKNDLSYTEAVEEALKEGKLTKEKQAIKDRLPYYGAVLQEST

QKIIAKGFSPQFKDKGYKTPHTNKYELEYGRIANPVVHQTLNELRKLVNEIIDILGKKPCEIGL

ETARELKKSAEDRSKLSREQNDNESNRNRIYEIYIRPQQQVIITRRENPRNYILKFELLEEQKS

QCPFCGGQISPNDIINNQADIEHLFPIAESEDNGRNNLVISHSACNADKAKRSPWAAFASAAKD

SKYDYNRILSNVKENIPHKAWRFNQGAFEKFIENKPMAARFKTDNSYISKVAHKYLACLFEKPN

IICVKGSLTAQLRMAWGLQGLMIPFAKQLITEKESESFNKDVNSNKKIRLDNRHHALDAIVIAY

ASRGYGNLLNKMAGKDYKINYSERNWLSKILLPPNNIVWENIDADLESFESSVKTALKNAFISV

KHDHSDNGELVKGTMYKIFYSERGYTLTTYKKLSALKLTDPQKKKTPKDFLETALLKFKGRESE

MKNEKIKSAIENNKRLFDVIQDNLEKAKKLLEEENEKSKAEGKKEKNINDASIYQKAISLSGDK

YVQLSKKEPGKFFAISKPTPTTTGYGYDTGDSLCVDLYYDNKGKLCGEIIRKIDAQQKNPLKYK

EQGFTLFERIYGGDILEVDFDIHSDKNSFRNNTGSAPENRVFIKVGTFTEITNNNIQIWFGNII

KSTGGQDDSFTINSMQQYNPRKLILSSCGFIKYRSPILKNKEG

SEQ ID NO: 361
MAAFKPNPINYILGLDIGIASVGWAMVEIDEDENPICLIDLGVRVFERAEVPKTGDSLAMARRL

ARSVRRLTRRRAHRLLRARRLLKREGVLQAADFDENGLIKSLPNTPWQLRAAALDRKLTPLEWS

AVLLHLIKHRGYLSQRKNEGETADKELGALLKGVADNAHALQTGDFRTPAELALNKFEKESGHI

RNQRGDYSHTFSRKDLQAELILLFEKQKEFGNPHVSGGLKEGIETLLMTQRPALSGDAVQKMLG

HCTFEPAEPKAAKNTYTAERFIWLTKLNNLRILEQGSERPLTDTERATLMDEPYRKSKLTYAQA

RKLLGLEDTAFFKGLRYGKDNAEASTLMEMKAYHAISRALEKEGLKDKKSPLNLSPELQDEIGT

AFSLFKTDEDITGRLKDRIQPEILEALLKHISFDKFVQISLKALRRIVPLMEQGKRYDEACAEI

-continued

YGDHYGKKNTEEKIYLPPIPADEIRNPVVLRALSQARKVINGVVRRYGSPARIHIETAREVGKS

FKDRKEIEKRQEENRKDREKAAAKFREYFPNFVGEPKSKDILKLRLYEQQHGKCLYSGKEINLG

RLNEKGYVEIDHALPFSRTWDDSFNNKVLVLGSENQNKGNQTPYEYFNGKDNSREWQEFKARVE

TSRFPRSKKQRILLQKFDEDGFKERNLNDTRYVNRFLCQFVADRMRLTGKGKKRVFASNGQITN

LLRGFWGLRKVRAENDRHHALDAVVVACSTVAMQQKITRFVRYKEMNAFDGKTIDKETGEVLHQ

KTHFPQPWEFFAQEVMIRVFGKPDGKPEFEEADTPEKLRTLLAEKLSSRPEAVHEYVTPLFVSR

APNRKMSGQGHMETVKSAKRLDEGVSVLRVPLTQLKLKDLEKMVNREREPKLYEALKARLEAHK

DDPAKAFAEPFYKYDKAGNRTQQVKAVRVEQVQKTGVWVRNHNGIADNATMVRVDVFEKGDKYY

LVPIYSWQVAKGILPDRAVVQGKDEEDWQLIDDSFNFKFSLHPNDLVEVITKKARMFGYFASCH

RGTGNINIRIHDLDHKIGKNGILEGIGVKTALSFQKYQIDELGKEIRPCRLKKRPPVR

SEQ ID NO: 362
MQTTNLSYILGLDLGIASVGWAVVEINENEDPIGLIDVGVRIFERAEVPKTGESLALSRRLARS

TRRLIRRRAHRLLLAKRFLKREGILSTIDLEKGLPNQAWELRVAGLERRLSAIEWGAVLLHLIK

HRGYLSKRKNESQTNNKELGALLSGVAQNHQLLQSDDYRTPAELALKKFAKEEGHIRNQRGAYT

HTFNRLDLLAELNLLFAQQHQFGNPHCKEHIQQYMTELLMWQKPALSGEAILKMLGKCTHEKNE

FKAAKHTYSAERFVWLTKLNNLRILEDGAERALNEEERQLLINHPYEKSKLTYAQVRKLLGLSE

QAIFKHLRYSKENAESATFMELKAWHAIRKALENQGLKDTWQDLAKKPDLLDEIGTAFSLYKTD

EDIQQYLTNKVPNSVINALLVSLNFDKFIELSLKSLRKILPLMEQGKRYDQACREIYGHHYGEA

NQKTSQLLPAIPAQEIRNPVVLRTLSQARKVINAIIRQYGSPARVHIETGRELGKSFKERREIQ

KQQEDNRTKRESAVQKFKELFSDFSSEPKSKDILKFRLYEQQHGKCLYSGKEINIHRLNEKGYV

EIDHALPFSRTWDDSFNNKVLVLASENQNKGNQTPYEWLQGKINSERWKNFVALVLGSQCSAAK

KQRLLTQVIDDNKFIDRNLNDTRYIARFLSNYIQENLLLVGKNKKNVFTPNGQITALLRSRWGL

IKARENNNRRHHALDAIVVACATPSMQQKITRFIRFKEVHPYKIENRYEMVDQESGEIISPHFPE

PWAYFRQEVNIRVFDNHPDTVLKEMLPDRPQANHQFVQPLFVSRAPTRKMSGQGHMETIKSAKR

LAEGISVLRIPLTQLKPNLLENMVNKEREPALYAGLKARLAEFNQDPAKAFATPFYKQGGQQVK

AIRVEQVQKSGVLVRENNGVADNASIVRTDVFIKNNKFFLVPIYTWQVAKGILPNKAIVAHKNE

DEWEEMDEGAKFKFSLFPNDLVELKTKKEYFFGYYIGLDRATGNISLKEHDGEISKGKDGVYRV

GVKLALSFEKYQVDELGKNRQICRPQQRQPVR

SEQ ID NO: 363
MGIRFAFDLGTNSIGWAVVWRTGPGVFGEDTAASLDGSGVLIFKDGRNPKDGQSLATMRRVPRQS

RKRRDRFVLRRRDLLAALRKAGLFPVDVEEGRRLAATDPYHLRAKALDESLTPHEMGRVIFHLN

QRRGFRSNRKADRQDREKGKIAEGSKRLAETLAATNCRTLGEFLWSRHRGTPRTRSPTRIRMEG

EGAKALYAFYPTREMVRAEFERLWTAQSRFAPDLLTPERHEEIAGILFRQRDLAPPKIGCCTFE

PSERRLPRALPSVEARGIYERLAHLRITTGPVSDRGLTRPERDVLASALLAGKSLTFKAVRKTL

KILPHALVNFEEAGEKGLDGALTAKLLSKPDHYGAAWHGLSFAEKDTFVGKLLDEADEERLIRR

LVTENRLSEDAARRCASIPLADGYGRLGRTANTEILAALVEETDETGTVVTYAEAVRRAGERTG

RNWHHSDERDGVILDRLPYYGEILQRHVVPGSGEPEEKNEAARWGRLANPTVHIGLNQLRKVVN

RLIAAHGRPDQIVVELARELKLNREQKERLDRENRKNREENERRTAILAEHGQRDTAENKIRLR

LFEEQARANAGIALCPYTGRAIGIAELFTSEVEIDHILPVSLTLDDSLANRVLCRREANREKRR

QTPFQAFGATPAWNDIVARAAKLPPNKRWRFDPAALERFEREGGFLGRQLNETKYLSRLAKIYL

GKICDPDRVYVTPGTLTGLLRARWGLNSILSDSNFKNRSDHRHHAVDAVVIGVLTRGMIQRIAH

-continued
DAARAEDQDLDRVFRDVPVPFEDFRDHVRERVSTITVAVKPEHGKGGALHEDTSYGLVPDTDPN

AALGNLVVRKPIRSLTAGEVDRVRDRALRARLGALAAPFRDESGRVRDAKGLAQALEAFGAENG

IRRVRILKPDASVVTIADRRTGVPYRAVAPGENHHVDIVQMRDGSWRGFAASVFEVNRPGWRPE

WEVKKLGGKLVMRLHKGDMVELSDKDGQRRVKVVQQIEISANRVRLSPHNDGGKLQDRHADADD

PFRWDLATIPLLKDRGCVAVRVDPIGVVTLRRSNV

SEQ ID NO: 364
MMEVFMGRLVLGLDIGITSVGFGIIDLDESEIVDYGVRLFKEGTAAENETRRTKRGGRRLKRRR

VTRREDMLHLLKQAGIISTSFHPLNNPYDVRVKGLNERLNGEELATALLHLCKHRGSSVETIED

DEAKAKEAGETKKVLSMNDQLLKSGKYVCEIQKERLRTNGHIRGHENNFKTRAYVDEAFQILSH

QDLSNELKSAIITIISRKRMYYDGPGGPLSPTPYGRYTYFGQKEPIDLIEKMRGKCSLFPNEPR

APKLAYSAELFNLLNDLNNLSIEGEKLTSEQKAMILKIVHEKGKITPKQLAKEVGVSLEQIRGF

RIDTKGSPLLSELTGYKMIREVLEKSNDEHLEDHVFYDEIAEILTKTKDIEGRKKQISELSSDL

NEESVHQLAGLTKFTAYHSLSFKALRLINEEMLKTELNQMQSITLFGLKQNNELSVKGMKNIQA

DDTAILSPVAKRAQRETFKVVNRLREIYGEFDSIVVEMAREKNSEEQRKAIRERQKFFEMRNKQ

VADIIGDDRKINAKLREKLVLYQEQDGKTAYSLEPIDLKLLIDDPNAYEVDHIIPISISLDDSI

TNKVLVTHRENQEKGNLTPISAFVKGRFTKGSLAQYKAYCLKLKEKNIKTNKGYRKKVEQYLLN

ENDIYKYDIQKEFINRNLVDTSYASRVVLNTLTTYFKQNEIPTKVFTVKGSLTNAFRRKINLKK

DRDEDYGHHAIDALIIASMPKMRLLSTIFSRYKIEDIYDESTGEVFSSGDDSMYYDDRYFAFIA

SLKAIKVRKFSHKIDTKPNRSVADETIYSTRVIDGKEKVVKKYKDIYDPKFTALAEDILNNAYQ

EKYLMALHDPQTFDQIVKVVNYYFEEMSKSEKYFTKDKKGRIKISGMNPLSLYRDEHGMLKKYS

KKGDGPAITQMKYFDGVLGNHIDISAHYQVRDKKVVLQQISPYRTDFYYSKENGYKFVTIRYKD

VRWSEKKKKYVIDQQDYAMKKAEKKIDDTYEFQFSMHRDELIGITKAEGEALIYPDETWHNFNF

FFHAGETPEILKFTATNNDKSNKIEVKPIHCYCKMRLMPTISKKIVRIDKYATDVVGNLYKVKK

NTLKFEFD

SEQ ID NO: 365
MKKILGVDLGITSFGYAILQETGKDLYRCLDNSVVMRNNPYDEKSGESSQSIRSTQKSMRRLIE

KRKKRIRCVAQTMERYGILDYSETMKINDPKNNPIKNRWQLRAVDAWKRPLSPQELFAIFAHMA

KHRGYKSIATEDLIYELELELGLNDPEKESEKKADERRQVYNALRHLEELRKKYGGETIAQTIH

RAVEAGDLRSYRNHDDYEKMIRREDIEEEIEKVLLRQAELGALGLPEEQVSELIDELKACITDQ

EMPTIDESLFGKCTFYKDELAAPAYSYLYDLYRLYKKLADLNIDGYEVTQEDREKVIEWVEKKI

AQGKNLKKITHKDLRKILGLAPEQKIFGVEDERIVKGKKEPRTFVPFFFLADIAKFKELFASIQ

KHPDALQIFRELAEILQRSKTPQEALDRLRALMAGKGIDTDDRELLELFKNKRSGTRELSHRYI

LEALPLFLEGYDEKEVQRILGFDDREDYSRYPKSLRHLHLREGNLFEKEENPINNHAVKSLASW

ALGLIADLSWRYGPFDEIILETTRDALPEKIRKEIDKAMREREKALDKIIGKYKKEFPSIDKRL

ARKIQLWERQKGLDLYSGKVINLSQLLDGSADIEHIVPQSLGGLSTDYNTIVTLKSVNAAKGNR

LPGDWLAGNPDYRERIGMLSEKGLIDWKKRKNLLAQSLDEIYTENTHSKGIRATSYLEALVAQV

LKRYYPFPDPELRKNGIGVRMIPGKVTSKTRSLLGIKSKSRETNFHHAEDALILSTLTRGWQNR

LHRMLRDNYGKSEAELKELWKKYMPHIEGLTLADYIDEAFRRFMSKGEESLFYRDMFDTIRSIS

YWVDKKPLSASSHKETVYSSRHEVPTLRKNILEAFDSLNVIKDRHKLTTEEFMKRYDKEIRQKL

WLHRIGNTNDESYRAVEERATQIAQILTRYQLMDAQNDKEIDEKFQQALKELITSPIEVTGKLL

RKMRFVYDKLNAMQIDRGLVETDKNMLGIHISKGPNEKLIFRRMDVNNAHELQKERSGILCYLN

```
EMLFIFNKKGLIHYGCLRSYLEKGQGSKYIALFNPRFPANPKAQPSKFTSDSKIKQVGIGSATG
IIKAHLDLDGHVRSYEVFGTLPEGSIEWFKEESGYGRVEDDPHH
```

SEQ ID NO: 366
```
MRPIEPWILGLDIGTDSLGWAVFSCEEKGPPTAKELLGGGVRLFDSGRDAKDHTSRQAERGAFR
RARRQTRTWPWRRDRLIALFQAAGLTPPAAETRQIALALRREAVSRPLAPDALWAALLHLAHHR
GFRSNRIDKRERAAAKALAKAKPAKATAKATAPAKEADDEAGFWEGAEAALRQRMAASGAPTVG
ALLADDLDRGQPVRMRYNQSDRDGVVAPTRALIAEELAEIVARQSSAYPGLDWPAVTRLVLDQR
PLRSKGAGPCAFLPGEDRALRALPTVQDFIIRQTLANLRLPSTSADEPRPLTDEEHAKALALLS
TARFVEWPALRRALGLKRGVKFTAETERNGAKQAARGTAGNLTEAILAPLIPGWSGWDLDRKDR
VFSDLWAARQDRSALLALIGDPRGPTRVTEDETAEAVADAIQIVLPTGRASLSAKAARAIAQAM
APGIGYDEAVTLALGLHHSHRPRQERLARLPYYAAALPDVGLDGDPVGPPPAEDDGAAAEAYYG
RIGNISVHIALNETRKIVNALLHRHGPILRLVMVETTRELKAGADERKRMIAEQAERERENAEI
DVELRKSDRWMANARERRQRVRLARRQNNLCPYTSTPIGHADLLGDAYDIDHVIPLARGGRDSL
DNMVLCQSDANKTKGDKTPWEAFHDKPGWIAQRDDFLARLDPQTAKALAWRFADDAGERVARKS
AEDEDQGFLPRQLTDTGYIARVALRYLSLVTNEPNAVVATNGRLTGLLRLAWDITPGPAPRDLL
PTPRDALRDDTAARRFLDGLTPPPLAKAVEGAVQARLAALGRSRVADAGLADALGLTLASLGGG
GKNRADHRHHFIDAAMIAVTTRGLINQINQASGAGRILDLRKWPRTNFEPPYPTFRAEVMKQWD
HIHPSIRPAHRDGGSLHAATVFGVRNRPDARVLVQRKPVEKLFLDANAKPLPADKIAEIIDGFA
SPRMAKRFKALLARYQAAHPEVPPALAALAVARDPAFGPRGMTANTVIAGRSDGDGEDAGLITP
FRANPKAAVRTMGNAVYEVWEIQVKGRPRWTHRVLTRFDRTQPAPPPPPENARLVMRLRRGDLV
YWPLESGDRLFLVKKMAVDGRLALWPARLATGKATALYAQLSCPNINLNGDQGYCVQSAEGIRK
EKIRTTSCTALGRLRLSKKAT
```

SEQ ID NO: 367
```
MKYTLGLDVGIASVGWAVIDKDNNKIIDLGVRCFDKAEESKTGESLATARRIARGMRRRISRRS
QRLRLVKKLFVQYEIIKDSSEFNRIFDTSRDGWKDPWELRYNALSRILKPYELVQVLTHITKRR
GFKSNRKEDLSTTKEGVVITSIKNNSEMLRTKNYRTIGEMIFMETPENSNKRNKVDEYIHTIAR
EDLLNEIKYIFSIQRKLGSPFVTEKLEHDFLNIWEFQRPFASGDSILSKVGKCTLLKEELRAPT
SCYTSEYFGLLQSINNLVLVEDNNTLTLNNDQRAKIIEYAHFKNEIKYSEIRKLLDIEPEILFK
AHNLTHKNPSGNNESKKFYEMKSYHKLKSTLPTDIWGKLHSNKESLDNLFYCLTVYKNDNEIKD
YLQANNLDYLIEYIAKLPTFNKFKHLSLVAMKRIIPFMEKGYKYSDACNMAELDFTGSSKLEKC
NKLTVEPIIENVTNPVVIRALTQARKVINAIIQKYGLPYMVNIELAREAGMTRQDRDNLKKEHE
NNRKAREKISDLIRQNGRVASGLDILKWRLWEDQGGRCAYSGKPIPVCDLLNDSLTQIDHIYPY
SRSMDDSYMNKVLVLTDENQNKRSYTPYEVWGSTEKWEDFEARIYSMHLPQSKEKRLLNRNFIT
KDLDSFISRNLNDTRYISRFLKNYIESYLQFSNDSPKSCVVCVNGQCTAQLRSRWGLNKNREES
DLHHALDAAVIACADRKIIKEITNYYNERENHNYKVKYPLPWHSFRQDLMETLAGVFISRAPRR
KITGPAHDETIRSPKHFNKGLTSVKIPLTTVTLEKLETMVKNTKGGISDKAVYNVLKNRLIEHN
NKPLKAFAEKIYKPLKNGTNGAIIRSIRVETPSYTGVFRNEGKGISDNSLMVRVDVFKKKDKYY
LVPIYVAHMIKKELPSKAIVPLKPESQWELIDSTHEFLFSLYQNDYLVIKTKKGITEGYYRSCH
RGTGSLSLMPHFANNKNVKIDIGVRTAISIEKYNVDILGNKSIVKGEPRRGMEKYNSFKSN
```

SEQ ID NO: 368
```
MIRTLGIDIGIASIGWAVIEGEYTDKGLENKEIVASGVRVFTKAENPKNKESLALPRTLARSAR
RRNARKKGRIQQVKHYLSKALGLDLECFVQGEKLATLFQTSKDFLSPWELRERALYRVLDKEEL
```

-continued

ARVILHIAKRRGYDDITYGVEDNDSGKIKKAIAENSKRIKEEQCKTIGEMMYKLYFQKSLNVRN

KKESYNRCVGRSELREELKTIFQIQQELKSPWVNEELIYKLLGNPDAQSKQEREGLIFYQRPLK

GFGDKIGKCSHIKKGENSPYRACKHAPSAEEFVALTKSINFLKNLTNRHGLCFSQEDMCVYLGK

ILQEAQKNEKGLTYSKLKLLLDLPSDFEFLGLDYSGKNPEKAVFLSLPSTFKLNKITQDRKTQD

KIANILGANKDWEAILKELESLQLSKEQIQTIKDAKLNFSKHINLSLEALYHLLPLMREGKRYD

EGVEILQERGIFSKPQPKNRQLLPPLSELAKEESYFDIPNPVLRRALSEFRKVVNALLEKYGGF

HYFHIELTRDVCKAKSARMQLEKINKKNKSENDAASQLLEVLGLPNTYNNRLKCKLWKQQEEYC

LYSGEKITIDHLKDQRALQIDHAFPLSRSLDDSQSNKVLCLTSSNQEKSNKTPYEWLGSDEKKW

DMYVGRVYSSNFSPSKKRKLTQKNFKERNEEDFLARNLVDTGYIGRVTKEYIKHSLSFLPLPDG

KKEHIRIISGSMTSTMRSFWGVQEKNRDHHLHHAQDAIIACIEPSMIQKYTTYLKDKETHRLK

SHQKAQILREGDHKLSLRWPMSNFKDKIQESIQNIIPSHHVSHKVTGELHQETVRTKEFYYQAF

GGEEGVKKALKFGKIREINQGIVDNGAMVRVDIFKSKDKGKFYAVPIYTYDFAIGKLPNKAIVQ

GKKNGIIKDWLEMDENYEFCFSLFKNDCIKIQTKEMQEAVLAIYKSTNSAKATIELEHLSKYAL

KNEDEEKMFTDTDKEKNKTMTRESCGIQGLKVFQKVKLSVLGEVLEHKPRNRQNIALKTTPKHV

SEQ ID NO: 369
MKYSIGLDIGIASVGWSVINKDKERIEDMGVRIFQKAENPKDGSSLASSRREKRGSRRRNRRKK

HRLDRIKNILCESGLVKKNEIEKIYKNAYLKSPWELRAKSLEAKISNKEIAQILLHIAKRRGFK

SFRKTDRNADDTGKLLSGIQENKKIMEEKGYLTIGDMVAKDPKFNTHVRNKAGSYLFSFSRKLL

EDEVRKIQAKQKELGNTHFTDDVLEKYIEVFNSQRNFDEGPSKPSPYYSEIGQIAKMIGNCTFE

SSEKRTAKNTWSGERFVFLQKLNNFRIVGLSGKRPLTEEERDIVEKEVYLKKEVRYEKLRKILY

LKEEERFGDLNYSKDEKQDKKTEKTKFISLIGNYTIKKLNLSEKLKSEIEEDKSKLDKIIEILT

FNKSDKTIESNLKKLELSREDIEILLSEEFSGTLNLSLKAIKKILPYLEKGLSYNEACEKADYD

YKNNGIKFKRGELLPVVDKDLIANPVVLRAISQTRKVVNAIIRKYGTPHTIHVEVARDLAKSYD

DRQTIIKENKKRELENEKTKKFISEEFGIKNVKGKLLLKYRLYQEQEGRCAYSRKELSLSEVIL

DESMTDIDHIIPYSRSMDDSYSNKVLVLSGENRKKSNLLPKEYFDRQGRDWDTFVLNVKAMKIH

PRKKSNLLKEKFTREDNKDWKSRALNDTRYISRFVANYLENALEYRDDSPKKRVFMIPGQLTAQ

LRARWRLNKVRENGDLHHALDAAVVAVTDQKAINNISNISRYKELKNCKDVIPSIEYHADEETG

EVYFEEVKDTRFPMPWSGFDLELQKRLESENPREEFYNLLSDKRYLGWFNYEEGFIEKLRPVFV

SRMPNRGVKGQAHQETIRSSKKISNQIAVSKKPLNSIKLKDLEKMQGRDTDRKLYEALKNRLEE

YDDKPEKAFAEPFYKPTNSGKRGPLVRGIKVEEKQNVGVYVNGGQASNGSMVRIDVFRKNGKFY

TVPIYVHQTLLKELPNRAINGKPYKDWDLIDGSFEFLYSFYPNDLIEIEFGKSKSIKNDNKLTK

TEIPEVNLSEVLGYYRGMDTSTGAATIDTQDGKIQMRIGIKTVKNIKKYQVDVLGNVYKVKREK

RQTF

SEQ ID NO: 370
MSKKVSRRYEEQAQEICQRLGSRPYSIGLDLGVGSIGVAVAAYDPIKKQPSDLVFVSSRIFIPS

TGAAERRQKRGQRNSLRHRANRLKFLWKLLAERNLMLSYSEQDVPDPARLRFEDAVVRANPYEL

RLKGLNEQLTLSELGYALYHIANHRGSSSVRTFLDEEKSSDDKKLEEQQAMTEQLAKEKGISTF

IEVLTAFNTNGLIGYRNSESVKSKGVPVPTRDIISNEIDVLLQTQKQFYQEILSDEYCDRIVSA

ILFENEKIVPEAGCCPYFPDEKKLPRCHFLNEERRLWEAINNARIKMPMQEGAAKRYQSASFSD

EQRHILFHIARSGTDITPKLVQKEFPALKTSIIVLQGKEKAIQKIAGFRFRRLEEKSFWKRLSE

EQKDDFFSAWTNTPDDKRLSKYLMKHLLLTENEVVDALKTVSLIGDYGPIGKTATQLLMKHLED

-continued

GLTYTEALERGMETGEFQELSVWEQQSLLPYYGQILTGSTQALMGKYWHSAFKEKRDSEGFFKP

NTNSDEEKYGRIANPVVHQTLNELRKLMNELITILGAKPQEITVELARELKVGAEKREDIIKQQ

TKQEKEAVLAYSKYCEPNNLDKRYIERFRLLEDQAFVCPYCLEHISVADIAAGRADVDHIFPRD

DTADNSYGNKVVAHRQCNDIKGKRTPYAAFSNTSAWGPIMHYLDETPGMWRKRRKFETNEEEYA

KYLQSKGFVSRFESDNSYIAKAAKEYLRCLFNPNNVTAVGSLKGMETSILRKAWNLQGIDDLLG

SRHWSKDADTSPTMRKNRDDNRHHGLDAIVALYCSRSLVQMINTMSEQGKRAVEIEAMIPIPGY

ASEPNLSFEAQRELFRKKILEFMDLHAFVSMKTDNDANGALLKDTVYSILGADTQGEDLVFVVK

KKIKDIGVKIGDYEEVASAIRGRITDKQPKWYPMEMKDKIEQLQSKNEAALQKYKESLVQAAAV

LEESNRKLIESGKKPIQLSEKTISKKALELVGGYYYLISNNKRTKTFVVKEPSNEVKGFAFDTG

SNLCLDFYHDAQGKLCGEIIRKIQAMNPSYKPAYMKQGYSLYVRLYQGDVCELRASDLTEAESN

LAKTTHVRLPNAKPGRTFVIIITFTEMGSGYQIYFSNLAKSKKGQDTSFTLTTIKNYDVRKVQL

SSAGLVRYVSPLLVDKIEKDEVALCGE

SEQ ID NO: 371

MNQKFILGLDIGITSVGYGLIDYETKNIIDAGVRLFPEANVENNEGRRSKRGSRRLKRRRIHRL

ERVKKLLEDYNLLDQSQIPQSTNPYAIRVKGLSEALSKDELVIALLHIAKRRGIHKIDVIDSND

DVGNELSTKEQLNKNSKLLKDKFVCQIQLERMNEGQVRGEKNRFKTADIIKEIIQLLNVQKNFH

QLDENFINKYIELVEMRREYFEGPGKGSPYGWEGDPKAWYETLMGHCTYFPDELRSVKYAYSAD

LFNALNDLNNLVIQRDGLSKLEYHEKYHIIENVFKQKKKPTLKQIANEINVNPEDIKGYRITKS

GKPQFTEFKLYHDLKSVLFDQSILENEDVLDQIAEILTIYQDKDSIKSKLTELDILLNEEDKEN

IAQLTGYTGTHRLSLKCIRLVLEEQWYSSRNQMEIFTHLNIKPKKINLTAANKIPKAMIDEFIL

SPVVKRTFGQAINLINKIIEKYGVPEDIIIELARENNSKDKQKFINEMQKKNENTRKRINEIIG

KYGNQNAKRLVEKIRLHDEQEGKCLYSLESIPLEDLLNNPNHYEVDHIIPRSVSFDNSYHNKVL

VKQSENSKKSNLTPYQYFNSGKSKLSYNQFKQHILNLSKSQDRISKKKKEYLLEERDINKFEVQ

KEFINRNLVDTRYATRELTNYLKAYFSANNMNVKVKTINGSFTDYLRKVWKFKKERNHGYKHHA

EDALIIANADFLFKENKKLKAVNSVLEKPEIESKQLDIQVDSEDNYSEMFIIPKQVQDIKDFRN

FKYSHRVDKKPNRQLINDTLYSTRKKDNSTYIVQTIKDIYAKDNTTLKKQFDKSPEKFLMYQHD

PRTFEKLEVIMKQYANEKNPLAKYHEETGEYLTKYSKKNNGPIVKSLKYIGNKLGSHLDVTHQF

KSSTKKLVKLSIKPYRFDVYLTDKGYKFITISYLDVLKKDNYYYIPEQKYDKLKLGKAIDKNAK

FIASFYKNDLIKLDGEIYKIIGVNSDTRNMIELDLPDIRYKEYCELNNIKGEPRIKKTIGKKVN

SIEKLTTDVLGNVFTNTQYTKPQLLFKRGN

SEQ ID NO: 372

MIMKLEKWRLGLDLGTNSIGWSVFSLDKDNSVQDLIDMGVRIFSDGRDPKTKEPLAVARRTARS

QRKLIYRRKLRRKQVFKFLQEQGLFPKTKEECMTLKSLNPYELRIKALDEKLEPYELGRALFNL

AVRRGFKSNRKDGSREEVSEKKSPDEIKTQADMQTHLEKAIKENGCRTITEFLYKNQGENGGIR

FAPGRMTYYPTRKMYEEEFNLIRSKQEKYYPQVDWDDIYKAIFYQRPLKPQQRGYCIYENDKER

TFKAMPCSQKLRILQDIGNLAYYEGGSKKRVELNDNQDKVLYELLNSKDKVTFDQMRKALCLAD

SNSFNLEENRDFLIGNPTAVKMRSKNRFGKLWDEIPLEEQDLIIETIITADEDDAVYEVIKKYD

LTQEQRDFIVKNTILQSGTSMLCKEVSEKLVKRLEEIADLKYHEAVESLGYKFADQTVEKYDLL

PYYGKVLPGSTMEIDLSAPETNPEKHYGKISNPTVHVALNQTRVVVNALIKEYGKPSQIAIELS

RDLKNNVEKKAEIARKQNQRAKENIAINDTISALYHTAFPGKSFYPNRNDRMKYRLWSELGLGN

KCIYCGKGISGAELFTKEIEIEHILPFSRTLLDAESNLTVAHSSCNAFKAERSPFEAFGTNPSG

YSWQEIIQRANQLKNTSKKNKFSPNAMDSFEKDSSFIARQLSDNQYIAKAALRYLKCLVENPSD

VWTTNGSMTKLLRDKWEMDSILCRKFTEKEVALLGLKPEQIGNYKKNRFDHRHHAIDAVVIGLT

DRSMVQKLATKNSHKGNRIEIPEFPILRSDLIEKVKNIVVSFKPDHGAEGKLSKETLLGKIKLH

GKETFVCRENIVSLSEKNLDDIVDEIKSKVKDYVAKHKGQKIEAVLSDFSKENGIKKVRCVNRV

QTPIEITSGKISRYLSPEDYFAAVIWEIPGEKKTFKAQYIRRNEVEKNSKGLNVVKPAVLENGK

PHPAAKQVCLLHKDDYLEFSDKGKMYFCRIAGYAATNNKLDIRPVYAVSYCADWINSTNETMLT

GYWKPTPTQNWVSVNVLFDKQKARLVTVSPIGRVFRK

SEQ ID NO: 373
MSSKAIDSLEQLDLFKPQEYTLGLDLGIKSIGWAILSGERIANAGVYLFETAEELNSTGNKLIS

KAAERGRKRRIRRMLDRKARRGRHIRYLLEREGLPTDELEEVVVHQSNRTLWDVRAEAVERKLT

KQELAAVLFHLVRHRGYFPNTKKLPPDDESDSADEEQGKINRATSRLREELKASDCKTIGQFLA

QNRDRQRNREGDYSNLMARKLVFEEALQILAFQRKQGHELSKDFEKTYLDVLMGQRSGRSPKLG

NCSLIPSELRAPSSAPSTEWFKFLQNLGNLQISNAYREEWSIDAPRRAQIIDACSQRSTSSYWQ

IRRDFQIPDEYRFNLVNYERRDPDVDLQEYLQQQERKTLANFRNWKQLEKIIGTGHPIQTLDEA

ARLITLIKDDEKLSDQLADLLPEASDKAITQLCELDFTTAAKISLEAMYRILPHMNQGMGFFDA

CQQESLPEIGVPPAGDRVPPFDEMYNPVVNRVLSQSRKLINAVIDEYGMPAKIRVELARDLGKG

RELRERIKLDQLDKSKQNDQRAEDFRAEFQQAPRGDQSLRYRLWKEQNCTCPYSGRMIPVNSVL

SEDTQIDHILPISQSFDNSLSNKVLCFTEENAQKSNRTPFEYLDAADFQRLEAISGNWPEAKRN

KLLHKSFGKVAEEWKSRALNDTRYLTSALADHLRHHLPDSKIQTVNGRITGYLRKQWGLEKDRD

KHTHHAVDAIVVACTTPAIVQQVTLYHQDIRRYKKLGEKRPTPWPETFRQDVLDVEEEIFITRQ

PKKVSGGIQTKDTLRKHRSKPDRQRVALTKVKLADLERLVEKDASNRNLYEHLKQCLEESGDQP

TKAFKAPFYMPSGPEAKQRPILSKVTLLREKPEPPKQLTELSGGRRYDSMAQGRLDIYRYKPGG

KRKDEYRVVLQRMIDLMRGEENVHVFQKGVPYDQGPEIEQNYTFLFSLYFDDLVEFQRSADSEV

IRGYYRTFNIANGQLKISTYLEGRQDFDFFGANRLAHFAKVQVNLLGKVIK

SEQ ID NO: 374
MRSLRYRLALDLGSTSLGWALFRLDACNRPTAVIKAGVRIFSDGRNPKDGSSLAVTRRAARAMR

RRRDRLLKRKTRMQAKLVEHGFFPADAGKRKALEQLNPYALRAKGLQEALLPGEFARALFHINQ

RRGFKSNRKTDKKDNDSGVLKKAIGQLRQQMAEQGSRTVGEYLWTRLQQGQGVRARYREKPYTT

EEGKKRIDKSYDLYIDRAMIEQEFDALWAAQAAFNPTLFHEAARADLKDTLLHQRPLRPVKPGR

CTLLPEEERAPLALPSTQRFRIHQEVNHLRLLDENLREVALTLAQRDAVVTALETKAKLSFEQI

RKLLKLSGSVQFNLEDAKRTELKGNATSAALARKELFGAAWSGFDEALQDEIVWQLVTEEGEGA

LIAWLQTHTGVDEARAQAIVDVSLPEGYGNLSRKALARIVPALRAAVITYDKAVQAAGFDHHSQ

LGFEYDASEVEDLVHPETGEIRSVFKQLPYYGKALQRHVAFGSGKPEDPDEKRYGKIANPTVHI

GLNQVRMVVNALIRRYGRPTEVVIELARDLKQSREQKVEAQRRQADNQRRNARIRRSIAEVLGI

GEERVRGSDIQKWICWEELSFDAADRRCPYSGVQISAAMLLSDEVEVEHILPFSKTLDDSLNNR

TVAMRQANRIKRNRTPWDARAEFEAQGWSYEDILQRAERMPLRKRYRFAPDGYERWLGDDKDFL

ARALNDTRYLSRVAAEYLRLVCPGTRVIPGQLTALLRGKFGLNDVLGLDGEKNRNDHRHHAVDA

CVIGVTDQGLMQRFATASAQARGDGLTRLVDGMPMPWPTYRDHVERAVRHIWVSHRPDHGFEGA

MMEETSYGIRKDGSIKQRRKADGSAGREISNLIRIHEATQPLRHGVSADGQPLAYKGYVGGSNY

CIEITVNDKGKWEGEVISTFRAYGVVRAGGMGRLRNPHEGQNGRKLIMRLVIGDSVRLEVDGAE

RTMRIVKISGSNGQIFMAPIHEANVDARNTDKQDAFTYTSKYAGSLQKAKTRRVTISPIGEVRD

PGFKG

SEQ ID NO: 375

MARPAFRAPRREHVNGWTPDPHRISKPFFILVSWHLLSRVVIDSSSGCFPGTSRDHTDKFAEWE
CAVQPYRLSFDLGTNSIGWGLLNLDRQGKPREIRALGSRIFSDGRDPQDKASLAVARRLARQMR
RRRDRYLTRRTRLMGALVRFGLMPADPAARKRLEVAVDPYLARERATRERLEPFEIGRALFHLN
QRRGYKPVRTATKPDEEAGKVKEAVERLEAAIAAAGAPTLGAWFAWRKTRGETLRARLAGKGKE
AAYPFYPARRMLEAEFDTLWAEQARHHPDLLTAEAREILRHRIFHQRPLKPPPVGRCTLYPDDG
RAPRALPSAQRLRLFQELASLRVIHLDLSERPLTPAERDRIVAFVQGRPPKAGRKPGKVQKSVP
FEKLRGLLELPPGTGFSLESDKRPELLGDETGARIAPAFGPGWTALPLEEQDALVELLLTEAEP
ERAIAALTARWALDEATAAKLAGATLPDFHGRYGRRAVAELLPVLERETRGDPDGRVRPIRLDE
AVKLLRGGKDHSDFSREGALLDALPYYGAVLERHVAFGTGNPADPEEKRVGRVANPTVHIALNQ
LRHLVNAILARHGRPEEIVIELARDLKRSAEDRRREDKRQADNQKRNEERKRLILSLGERPTPR
NLLKLRLWEEQGPVENRRCPYSGETISMRMLLSEQVDIDHILPFSVSLDDSAANKVVCLREANR
IKRNRSPWEAFGHDSERWAGILARAEALPKNKRWRFAPDALEKLEGEGGLRARHLNDTRHLSRL
AVEYLRCVCPKVRVSPGRLTALLRRRWGIDAILAEADGPPPEVPAETLDPSPAEKNRADHRHHA
LDAVVIGCIDRSMVQRVQLAAASAEREAAAREDNIRRVLEGFKEEPWDGFRAELERRARTIVVS
HRPEHGIGGALHKETAYGPVDPPEEGFNLVVRKPIDGLSKDEINSVRDPRLRRALIDRLAIRRR
DANDPATALAKAAEDLAAQPASRGIRRVRVLKKESNPIRVEHGGNPSGPRSGGPFHKLLLAGEV
HHVDVALRADGRRWVGHWVTLFEAHGGRGADGAAAPPRLGDGERFLMRLHKGDCLKLEHKGRVR
VMQVVKLEPSSNSVVVVEPHQVKTDRSKHVKISCDQLRARGARRVTVDPLGRVRVHAPGARVGI
GGDAGRTAMEPAEDIS

SEQ ID NO: 376

MKRTSLRAYRLGVDLGANSLGWFVVWLDDHGQPEGLGPGGVRIFPDGRNPQSKQSNAAGRRLAR
SARRRRDRYLQRRGKLMGLLVKHGLMPADEPARKRLECLDPYGLRAKALDEVLPLHHVGRALFH
LNQRRGLFANRAIEQGDKDASAIKAAAGRLQTSMQACGARTLGEFLNRRHQLRATVRARSPVGG
DVQARYEFYPTRAMVDAEFEAIWAAQAPHHPTMTAEAHDTIREAIFSQRAMKRPSIGKCSLDPA
TSQDDVDGFRCAWSHPLAQRFRIWQDVRNLAVVETGPTSSRLGKEDQDKVARALLQTDQLSFDE
IRGLLGLPSDARFNLESDRRDHLKGDATGAILSARRHFGPAWHDRSLDRQIDIVALLESALDEA
AIIASLGTTHSLDEAAAQRALSALLPDGYCRLGLRAIKRVLPLMEAGRTYAEAASAAGYDHALL
PGGKLSPTGYLPYYGQWLQNDVVGSDDERDTNERRWGRLPNPTVHIGIGQLRRVVNELIRWHGP
PAEITVELTRDLKLSPRRLAELEREQAENQRKNDKRTSLLRKLGLPASTHNLLKLRLWDEQGDV
ASECPYTGEAIGLERLVSDDVDIDHLIPFSISWDDSAANKVVCMRYANREKGNRTPFEAFGHRQ
GRPYDWADIAERAARLPRGKRWRFGPGARAQFEELGDFQARLLNETSWLARVAKQYLAAVTHPH
RIHVLPGRLTALLRATWELNDLLPGSDDRAAKSRKDHRHHAIDALVAALTDQALLRRMANAHDD
TRRKIEVLLPWPTFRIDLETRLKAMLVSHKPDHGLQARLHEDTAYGTVEHPETEDGANLVYRKT
FVDISEKEIDRIRDRRLRDLVRAHVAGERQQGKTLKAAVLSFAQRRDIAGHPNGIRHVRLTKSI
KPDYLVPIRDKAGRIYKSYNAGENAFVDILQAESGRWIARATTVFQANQANESHDAPAAQPIMR
VFKGDMLRIDHAGAEKFVKIVRLSPSNNLLYLVEHHQAGVFQTRHDDPEDSFRWLFASFDKLRE
WNAELVRIDTLGQPWRRKRGLETGSEDATRIGWTRPKKWP

SEQ ID NO: 377

MERIFGFDIGTTSIGFSVIDYSSTQSAGNIQRLGVRIFPEARDPDGTPLNQQRRQKRMMRRQLR
RRRIRRKALNETLHEAGFLPAYGSADWPVVMADEPYELRRRGLEEGLSAYEFGRAIYHLAQHRH
FKGRELEESDTPDPDVDDEKEAANERAATLKALKNEQTTLGAWLARRPPSDRKRGIHAHRNVVA

-continued

EEFERLWEVQSKFHPALKSEEMRARISDTIFAQRPVFWRKNTLGECRFMPGEPLCPKGSWLSQQ

RRMLEKLNNLAIAGGNARPLDAEERDAILSKLQQQASMSWPGVRSALKALYKQRGEPGAEKSLK

FNLELGGESKLLGNALEAKLADMFGPDWPAHPRKQEIRHAVHERLWAADYGETPDKKRVIILSE

KDRKAHREAAANSFVADFGITGEQAAQLQALKLPTGWEPYSIPALNLFLAELEKGERFGALVNG

PDWEGWRRTNFPHRNQPTGEILDKLPSPASKEERERISQLRNPTVVRTQNELRKVVNNLIGLYG

KPDRIRIEVGRDVGKSKREREEIQSGIRRNEKQRKKATEDLIKNGIANPSRDDVEKWILWKEGQ

ERCPYTGDQIGFNALFREGRYEVEHIWPRSRSFDNSPRNKTLCRKDVNIEKGNRMPFEAFGHDE

DRWSAIQIRLQGMVSAKGGTGMSPGKVKRFLAKTMPEDFAARQLNDTRYAAKQILAQLKRLWPD

MGPEAPVKVEAVTGQVTAQLRKLWTLNNILADDGEKTRADHRHHAIDALTVACTHPGMTNKLSR

YWQLRDDPRAEKPALTPPWDTIRADAEKAVSEIVVSHRVRKKVSGPLHKETTYGDTGTDIKTKS

GTYRQFVTRKKIESLSKGELDEIRDPRIKEIVAAHVAGRGGDPKKAFPPYPCVSPGGPEIRKVR

LTSKQQLNLMAQTGNGYADLGSNHHIAIYRLPDGKADFEIVSLFDASRRLAQRNPIVQRTRADG

ASFVMSLAAGEAIMIPEGSKKGIWIVQGVWASGQVVLERDTDADHSTTTRPMPNPILKDDAKKV

SIDPIGRVRPSND

SEQ ID NO: 378

MNKRILGLDTGTNSLGWAVVDWDEHAQSYELIKYGDVIFQEGVKIEKGIESSKAAERSGYKAIR

KQYFRRRLRKIQVLKVLVKYHLCPYLSDDDLRQWHLQKQYPKSDELMLWQRTSDEEGKNPYYDR

HRCLHEKLDLTVEADRYTLGRALYHLTQRRGFLSNRLDTSADNKEDGVVKSGISQLSTEMEEAG

CEYLGDYFYKLYDAQGNKVRIRQRYTDRNKHYQHEFDAICEKQELSSELIEDLQRAIFFQLPLK

SQRHGVGRCTFERGKPRCADSHPDYEEFRMLCFVNNIQVKGPHDLELRPLTYEEREKIEPLFFR

KSKPNFDFEDIAKALAGKKNYAWIHDKEERAYKFNYRMTQGVPGCPTIAQLKSIFGDDWKTGIA

ETYTLIQKKNGSKSLQEMVDDVWNVLYSFSSVEKLKEFAHHKLQLDEESAEKFAKIKLSHSFAA

LSLKAIRKFLPFLRKGMYYTHASFFANIPTIVGKEIWNKEQNRKYIMENVGELVFNYQPKHREV

QGTIEMLIKDFLANNFELPAGATDKLYHPSMIETYPNAQRNEFGILQLGSPRTNAIRNPMAMRS

LHILRRVVNQLLKESIIDENTEVHVEYARELNDANKRRAIADRQKEQDKQHKKYGDEIRKLYKE

ETGKDIEPTQTDVLKFQLWEEQNHHCLYTGEQIGITDFIGSNPKFDIEHTIPQSVGGDSTQMNL

TLCDNRFNREVKKAKLPTELANHEEILTRIEPWKNKYEQLVKERDKQRTFAGMDKAVKDIRIQK

RHKLQMEIDYWRGKYERFTMTEVPEGFSRRQGTGIGLISRYAGLYLKSLFHQADSRNKSNVYVV

KGVATAEFRKMWGLQSEYEKKCRDNHSHHCMDAITIACIGKREYDLMAEYYRMEETFKQGRGSK

PKFSKPWATFTEDVLNIYKNLLVVHDTPNNMPKHTKKYVQTSIGKVLAQGDTARGSLHLDTYYG

AIERDGEIRYVVRRPLSSFTKPEELENIVDETVKRTIKEAIADKNFKQAIAEPIYMNEEKGILI

KKVRCFAKSVKQPINIRQHRDLSKKEYKQQYHVMNENNYLLAIYEGLVKNKVVREFEIVSYIEA

AKYYKRSQDRNIFSSIVPTHSTKYGLPLKTKLLMGQLVLMFEENPDEIQVDNTKDLVKRLYKVV

GIEKDGRIKFKYHQEARKEGLPIFSTPYKNNDDYAPIFRQSINNINILVDGIDFTIDILGKVTL

KE

SEQ ID NO: 379

MNYKMGLDIGIASVGWAVINLDLKRIEDLGVRIFDKAEHPQNGESLALPRRIARSARRRLRRRK

HRLERIRRLLVSENVLTKEEMNLLFKQKKQIDVWQLRVDALERKLNNDELARVLLHLAKRRGFK

SNRKSERNSKESSEFLKNIEENQSILAQYRSVGEMIVKDSKFAYHKRNKLDSYSNMIARDDLER

EIKLIFEKQREFNNPVCTERLEEKYLNIWSSQRPFASKEDIEKKVGFCTFEPKEKRAPKATYTF

QSFIVWEHINKLRLVSPDETRALTEIERNLLYKQAFSKNKMTYYDIRKLLNLSDDIHFKGLLYD

PKSSLKQIENIRFLELDSYHKIRKCIENVYGKDGIRMFNETDIDTFGYALTIFKDDEDIVAYLQ

```
NEYITKNGKRVSNLANKVYDKSLIDELLNLSFSKFAHLSMKAIRNILPYMEQGEIYSKACELAG

YNFTGPKKKEKALLLPVIPNIANPVVMRALTQSRKVVNAIIKKYGSPVSIHIELARDLSHSFDE

RKKIQKDQTENRKKNETAIKQLIEYELTKNPTGLDIVKFKLWSEQQGRCMYSLKPIELERLLEP

GYVEVDHILPYSRSLDDSYANKVLVLTKENREKGNHTPVEYLGLGSERWKKFEKFVLANKQFSK

KKKQNLLRLRYEETEEKEFKERNLNDTRYISKFFANFIKEHLKFADGDGGQKVYTINGKITAHL

RSRWDFNKNREESDLHHAVDAVIVACATQGMIKKITEFYKAREQNKESAKKKEPIFPQPWPHFA

DELKARLSKFPQESIEAFALGNYDRKKLESLRPVFVSRMPKRSVTGAAHQETLRRCVGIDEQSG

KIQTAVKTKLSDIKLDKDGHFPMYQKESDPRTYEAIRQRLLEHNNDPKKAFQEPLYKPKKNGEP

GPVIRTVKIIDTKNKVVHLDGSKTVAYNSNIVRTDVFEKDGKYYCVPVYTMDIMKGTLPNKAIE

ANKPYSEWKEMTEEYTFQFSLFPNDLVRIVLPREKTIKTSTNEEIIIKDIFAYYKTIDSATGGL

ELISHDRNFSLRGVGSKTLKRFEKYQVDVLGNIHKVKGEKRVGLAAPTNQKKGKTVDSLQSVSD
```

SEQ ID NO: 380
```
MRRLGLDLGTNSIGWCLLDLGDDGEPVSIFRTGARIFSDGRDPKSLGSLKATRREARLTRRRRD

RFIQRQKNLINALVKYGLMPADEIQRQALAYKDPYPIRKKALDEAIDPYEMGRAIFHINQRRGF

KSNRKSADNEAGVVKQSIADLEMKLGEAGARTIGEFLADRQATNDTVRARRLSGTNALYEFYPD

RYMLEQEFDTLWAKQAAFNPSLYIEAARERLKEIVFFQRKLKPQEVGRCIFLSDEDRISKALPS

FQRFRIYQELSNLAWIDHDGVAHRITASLALRDHLFDELEHKKKLTFKAMRAILRKQGVVDYPV

GFNLESDNRDHLIGNLTSCIMRDAKKMIGSAWDRLDEEEQDSFILMLQDDQKGDDEVRSILTQQ

YGLSDDVAEDCLDVRLPDGHGSLSKKAIDRILPVLRDQGLIYYDAVKEAGLGEANLYDPYAALS

DKLDYYGKALAGHVMGASGKFEDSDEKRYGTISNPTVHIALNQVRAVVNELIRLHGKPDEVVIE

IGRDLPMGADGKRELERFQKEGRAKNERARDELKKLGHIDSRESRQKFQLWEQLAKEPVDRCCP

FTGKMMSISDLFSDKVEIEHLLPFSLTLDDSMANKTVCFRQANRDKGNRAPFDAFGNSPAGYDW

QEILGRSQNLPYAKRWRFLPDAMKRFEADGGFLERQLNDTRYISRYTTEYISTIIPKNKIWVVT

GRLTSLLRGFWGLNSILRGHNTDDGTPAKKSRDDHRHHAIDAIVVGMTSRGLLQKVSKAARRSE

DLDLTRLFEGRIDPWDGFRDEVKKHIDAIIVSHRPRKKSQGALHNDTAYGIVEHAENGASTVVH

RVPITSLGKQSDIEKVRDPLIKSALLNETAGLSGKSFENAVQKWCADNSIKSLRIVETVSIIPI

TDKEGVAYKGYKGDGNAYMDIYQDPTSSKWKGEIVSRFDANQKGFIPSWQSQFPTARLIMRLRI

NDLLKLQDGEIEEIYRVQRLSGSKILMAPHTEANVDARDRDKNDTFKLTSKSPGKLQSASARKV

HISPTGLIREG
```

SEQ ID NO: 381
```
MKNILGLDLGLSSIGWSVIRENSEEQELVAMGSRVVSLTAAELSSFTQGNGVSINSQRTQKRTQ

RKGYDRYQLRRTLLRNKLDTLGMLPDDSLSYLPKLQLWGLRAKAVTQRIELNELGRVLLHLNQK

RGYKSIKSDFSGDKKITDYVKTVKTRYDELKEMRLTIGELFFRRLTENAFFRCKEQVYPRQAYV

EEFDCIMNCQRKFYPDILTDETIRCIRDEIIYYQRPLKSCKYLVSRCEFEKRFYLNAAGKKTEA

GPKVSPRTSPLFQVCRLWESINNIVVKDRRNEIVFISAEQRAALFDFLNTHEKLKGSDLLKLLG

LSKTYGYRLGEQFKTGIQGNKTRVEIERALGNYPDKKRLLQFNLQEESSSMVNTETGEIIPMIS

LSFEQEPLYRLWHVLYSIDDREQLQSVLRQKFGIDDDEVLERLSAIDLVKAGFGNKSSKAIRRI

LPFLQLGMNYAEACEAAGYNHSNNYTKAENEARALLDRLPAIKKNELRQPVVEKILNQMVNVVN

ALMEKYGRFDEIRVELARELKQSKEERSNTYKSINKNQRENEQIAKRIVEYGVPTRSRIQKYKM

WEESKHCCIYCGQPVDVGDFLRGFDVEVEHIIPKSLYFDDSFANKVCSCRSCNKEKNNRTAYDY

MKSKGEKALSDYVERVNTMYTNNQISKTKWQNLLTPVDKISIDFIDRQLRESQYIARKAKEILT
```

-continued

SICYNVTATSGSVTSFLRHVWGWDTVLHDLNFDRYKKVGLTEVIEVNHRGSVIRREQIKDWSKR

FDHRHHAIDALTIACTKQAYIQRLNNLRAEEGPDFNKMSLERYIQSQPHFSVAQVREAVDRILV

SFRAGKRAVTPGKRYIRKNRKRISVQSVLIPRGALSEESVYGVIHVWEKDEQGHVIQKQRAVMK

YPITSINREMLDKEKVVDKRIHRILSGRLAQYNDNPKEAFAKPVYIDKECRIPIRTVRCFAKPA

INTLVPLKKDDKGNPVAWVNPGNNHHVAIYRDEDGKYKERTVTFWEAVDRCRVGIPAIVTQPDT

IWDNILQRNDISENVLESLPDVKWQFVLSLQQNEMFILGMNEEDYRYAMDQQDYALLNKYLYRV

QKLSKSDYSFRYHTETSVEDKYDGKPNLKLSMQMGKLKRVSIKSLLGLNPHKVHISVLGEIKEI

S

SEQ ID NO: 382
MAEKQHRWGLDIGTNSIGWAVIALIEGRPAGLVATGSRIFSDGRNPKDGSSLAVERRGPRQMRR

RRDRYLRRRDRFMQALINVGLMPGDAAARKALVTENPYVLRQRGLDQALTLPEFGRALFHLNQR

RGFQSNRKTDRATAKESGKVKNAIAAFRAGMGNARTVGEALARRLEDGRPVRARMVGQGKDEHY

ELYIAREWIAQEFDALWASQQRFHAEVLADAARDRLRAILLFQRKLLPVPVGKCFLEPNQPRVA

AALPSAQRFRLMQELNHLRVMTLADKRERPLSFQERNDLLAQLVARPKCGFDMLRKIVFGANKE

AYRFTIESERRKELKGCDTAAKLAKVNALGTRWQALSLDEQDRLVCLLLDGENDAVLADALREH

YGLTDAQIDTLLGLSFEDGHMRLGRSALLRVLDALESGRDEQGLPLSYDKAVVAAGYPAHTADL

ENGERDALPYYGELLWRYTQDAPTAKNDAERKFGKIANPTVHIGLNQLRKLVNALIQRYGKPAQ

IVVELARNLKAGLEEKERIKKQQTANLERNERIRQKLQDAGVPDNRENRLRMRLFEELGQGNGL

GTPCIYSGRQISLQRLFSNDVQVDHILPFSKTLDDSFANKVLAQHDANRYKGNRGPFEAFGANR

DGYAWDDIRARAAVLPRNKRNRFAETAMQDWLHNETDFLARQLTDTAYLSRVARQYLTAICSKD

DVYVSPGRLTAMLRAKWGLNRVLDGVMEEQGRPAVKNRDDHRHHAIDAVVIGATDRAMLQQVAT

LAARAREQDAERLIGDMPTPWPNFLEDVRAAVARCVVSHKPDHGPEGGLHNDTAYGIVAGPFED

GRYRVRHRVSLFDLKPGDLSNVRCDAPLQAELEPIFEQDDARAREVALTALAERYRQRKVWLEE

LMSVLPIRPRGEDGKTLPDSAPYKAYKGDSNYCYELFINERGRWDGELISTFRANQAAYRRFRN

DPARFRRYTAGGRPLLMRLCINDYIAVGTAAERTIFRVVKMSENKITLAEHFEGGTLKQRDADK

DDPFKYLTKSPGALRDLGARRIFVDLIGRVLDPGIKGD

SEQ ID NO: 383
MIERILGVDLGISSLGWAIVEYDKDDEAANRIIDCGVRLFTAAETPKKKESPNKARREARGIRR

VLNRRRVRMNMIKKLFLRAGLIQDVDLDGEGGMFYSKANRADVWELRHDGLYRLLKGDELARVL

IHIAKHRGYKFIGDDEADEESGKVKKAGVVLRQNFEAAGCRTVGEWLWRERGANGKKRNKHGDY

EISIHRDLLVEEVEAIFVAQQEMRSTIATDALKAAYREIAFFVRPMQRIEKMVGHCTYFPEERR

APKSAPTAEKFIAISKFFSTVIIDNEGWEQKIIERKTLEELLDFAVSREKVEFRHLRKFLDLSD

NEIFKGLHYKGKPKTAKKREATLFDPNEPTELEFDKVEAEKKAWISLRGAAKLREALGNEFYGR

FVALGKHADEATKILTYYKDEGQKRRELTKLPLEAEMVERLVKIGFSDFLKLSLKAIRDILPAM

ESGARYDEAVLMLGVPHKEKSAILPPLNKTDIDILNPTVIRAFAQFRKVANALVRKYGAFDRVH

FELAREINTKGEIEDIKESQRKNEKERKEAADWIAETSFQVPLTRKNILKKRLYIQQDGRCAYT

GDVIELERLFDEGYCEIDHILPRSRSADDSFANKVLCLARANQQKTDRTPYEWFGHDAARWNAF

ETRTSAPSNRVRTGKGKIDRLLKKNFDENSEMAFKDRNLNDTRYMARAIKTYCEQYWVFKNSHT

KAPVQVRSGKLTSVLRYQWGLESKDRESHTHHAVDAIIIAFSTQGMVQKLSEYYRFKETHREKE

RPKLAVPLANFRDAVEEATRIENTETVKEGVEVKRLLISRPPRARVTGQAHEQTAKPYPRIKQV

KNKKKWRLAPIDEEKFESFKADRVASANQKNFYETSTIPRVDVYHKKGKFHLVPIYLHEMVLNE

LPNLSLGTNPEAMDENFFKFSIFKDDLISIQTQGTPKKPAKIIMGYFKNMHGANMVLSSINNSP

-continued

CEGFTCTPVSMDKKHKDKCKLCPEENRIAGRCLQGFLDYWSQEGLRPPRKEFECDQGVKFALDV

KKYQIDPLGYYYEVKQEKRLGTIPQMRSAKKLVKK

SEQ ID NO: 384
MNNSIKSKPEVTIGLDLGVGSVGWAIVDNETNIIHHLGSRLFSQAKTAEDRRSFRGVRRLIRRR

KYKLKRFVNLIWKYNSYFGFKNKEDILNNYQEQQKLHNTVLNLKSEALNAKIDPKALSWILHDY

LKNRGHFYEDNRDFNVYPTKELAKYFDKYGYYKGIIDSKEDNDNKLEEELTKYKFSNKHWLEEV

KKVLSNQTGLPEKFKEEYESLFSYVRNYSEGPGSINSVSPYGIYHLDEKEGKVVQKYNNIWDKT

IGKCNIFPDEYRAPKNSPIAMIFNEINELSTIRSYSIYLTGWFINQEFKKAYLNKLLDLLIKTN

GEKPIDARQFKKLREETIAESIGKETLKDVENEEKLEKEDHKWKLKGLKLNTNGKIQYNDLSSL

AKFVHKLKQHLKLDFLLEDQYATLDKINFLQSLFVYLGKHLRYSNRVDSANLKEFSDSNKLFER

ILQKQKDGLFKLFEQTDKDDEKILAQTHSLSTKAMLLAITRMTNLDNDEDNQKNNDKGWNFEAI

KNFDQKFIDITKKNNNLSLKQNKRYLDDRFINDAILSPGVKRILREATKVFNAILKQFSEEYDV

TKVVIELARELSEEKELENTKNYKKLIKKNGDKISEGLKALGISEDEIKDILKSPTKSYKFLLW

LQQDHIDPYSLKEIAFDDIFTKTEKFEIDHIIPYSISFDDSSSNKLLVLAESNQAKSNQTPYEF

ISSGNAGIKWEDYEAYCRKFKDGDSSLLDSTQRSKKFAKMMKTDTSSKYDIGFLARNLNDTRYA

TIVFRDALEDYANNHLVEDKPMFKVVCINGSVTSFLRKNFDDSSYAKKDRDKNIHHAVDASIIS

IFSNETKTLFNQLTQFADYKLFKNTDGSWKKIDPKTGVVTEVTDENWKQIRVRNQVSEIAKVIE

KYIQDSNIERKARYSRKIENKTNISLFNDTVYSAKKVGYEDQIKRKNLKTLDIHESAKENKNSK

VKRQFVYRKLVNVSLLNNDKLADLFAEKEDILMYRANPWVINLAEQIFNEYTENKKIKSQNVFE

KYMLDLTKEFPEKFSEFLVKSMLRNKTAIIYDDKKNIVHRIKRLKMLSSELKENKLSNVIIRSK

NQSGTKLSYQDTINSLALMIMRSIDPTAKKQYIRVPLNTLNLHLGDHDFDLHNMDAYLKKPKFV

KYLKANEIGDEYKPWRVLTSGTLLIHKKDKKLMYISSFQNLNDVIEIKNLIETEYKENDDSDSK

KKKKANRFLMTLSTILNDYILLDAKDNFDILGLSKNRIDEILNSKLGLDKIVK

SEQ ID NO: 385
MGGSEVGTVPVTWRLGVDVGERSIGLAAVSYEEDKPKEILAAVSWIHDGGVGDERSGASRLALR

GMARRARRLRRFRRARLRDLDMLLSELGWTPLPDKNVSPVDAWLARKRLAEEYVVDETERRLL

GYAVSHMARHRGWRNPWTTIKDLKNLPQPSDSWERTRESLEARYSVSLEPGTVGQWAGYLLQRA

PGIRLNPTQQSAGRRAELSNATAFETRLRQEDVLWELRCIADVQGLPEDVVSNVIDAVFCQKRP

SVPAERIGRDPLDPSQLRASRACLEFQEYRIVAAVANLRIRDGSGSRPLSLEERNAVIEALLAQ

TERSLTWSDIALEILKLPNESDLTSVPEEDGPSSLAYSQFAPFDETSARIAEFIAKNRRKIPTF

AQWWQEQDRTSRSDLVAALADNSIAGEEEQELLVHLPDAELEALEGLALPSGRVAYSRLTLSGL

TRVMRDDGVDVHNARKTCFGVDDNWRPPLPALHEATGHPVVDRNLAILRKFLSSATMRWGPPQS

IVVELARGASESRERQAEEEAARRAHRKANDRIRAELRASGLSDPSPADLVRARLLELYDCHCM

YCGAPISWENSELDHIVPRTDGGSNRHENLAITCGACNKEKGRRPFASWAETSNRVQLRDVIDR

VQKLKYSGNMYWTRDEFSRYKKSVVARLKRRTSDPEVIQSIESTGYAAVALRDRLLSYGEKNGV

AQVAVFRGGVTAEARRWLDISIERLFSRVAIFAQSTSTKRLDRRHHAVDAVVLTTLTPGVAKTL

ADARSRRVSAEFWRRPSDVNRHSTEEPQSPAYRQWKESCSGLGDLLISTAARDSIAVAAPLRLR

PTGALHEETLRAFSEHTVGAAWKGAELRRIVEPEVYAAFLALTDPGGRFLKVSPSEDVLPADEN

RHIVLSDRVLGPRDRVKLFPDDRGSIRVRGGAAYIASFHHARVFRWGSSHSPSFALLRVSLADL

AVAGLLRDGVDVFTAELPPWTPAWRYASIALVKAVESGDAKQVGWLVPGDELDFGPEGVTTAAG

-continued

DLSMFLKYFPERHWVVTGFEDDKRINLKPAFLSAEQAEVLRTERSDRPDTLTEAGEILAQFFPR

CWRATVAKVLCHPGLTVIRRTALGQPRWRRGHLPYSWRPWSADPWSGGTP

SEQ ID NO: 386
MHNKKNITIGFDLGIASIGWAIIDSTTSKILDWGTRTFEERKTANERRAFRSTRRNIRRKAYRN

QRFINLILKYKDLFELKNISDIQRANKKDTENYEKIISFFTEIYKKCAAKHSNILEVKVKALDS

KIEKLDLIWILHDYLENRGFFYDLEEENVADKYEGIEHPSILLYDFFKKNGFFKSNSSIPKDLG

GYSFSNLQWVNEIKKLFEVQEINPEFSEKFLNLFTSVRDYAKGPGSEHSASEYGIFQKDEKGKV

FKKYDNIWDKTIGKCSFFVEENRSPVNYPSYEIFNLLNQLINLSTDLKTTNKKIWQLSSNDRNE

LLDELLKVKEKAKIISISLKKNEIKKIILKDFGFEKSDIDDQDTIEGRKIIKEEPTTKLEVTKH

LLATIYSHSSDSNWININNILEFLPYLDAICIILDREKSRGQDEVLKKLTEKNIFEVLKIDREK

QLDFVKSIFSNTKFNFKKIGNFSLKAIREFLPKMFEQNKNSEYLKWKDEEIRRKWEEQKSKLGK

TDKKTKYLNPRIFQDEIISPGTKNTFEQAVLVLNQIIKKYSKENIIDAIIIESPREKNDKKTIE

EIKKRNKKGKGKTLEKLFQILNLENKGYKLSDLETKPAKLLDRLRFYHQQDGIDLYTLDKINID

QLINGSQKYEIEHIIPYSMSYDNSQANKILTEKAENLKKGKLIASEYIKRNGDEFYNKYYEKAK

ELFINKYKKNKKLDSYVDLDEDSAKNRFRFLTLQDYDEFQVEFLARNLNDTRYSTKLFYHALVE

HFENNEFFTYIDENSSKHKVKISTIKGHVTKYFRAKPVQKNNGPNENLNNNKPEKIEKNRENNE

HHAVDAAIVAIIGNKNPQIANLLTLADNKTDKKFLLHDENYKENIETGELVKIPKFEVDKLAKV

EDLKKIIQEKYEEAKKHTAIKFSRKTRTILNGGLSDETLYGFKYDEKEDKYFKIIKKKLVTSKN

EELKKYFENPFGKKADGKSEYTVLMAQSHLSEFNKLKEIFEKYNGFSNKTGNAFVEYMNDLALK

EPTLKAEIESAKSVEKLLYYNFKPSDQFTYHDNINNKSFKRFYKNIRIIEYKSIPIKFKILSKH

DGGKSFKDTLFSLYSLVYKVYENGKESYKSIPVTSQMRNFGIDEFDFLDENLYNKEKLDIYKSD

FAKPIPVNCKPVFVLKKGSILKKKSLDIDDFKETKETEEGNYYFISTISKRFNRDTAYGLKPLK

LSVVKPVAEPSTNPIFKEYIPIHLDELGNEYPVKIKEHTDDEKLMCTIK

Nucleic Acids Encoding Cas9 Molecules

Nucleic acids encoding the Cas9 molecules or Cas9 polypeptides, e.g., an eaCas9 molecule or eaCas9 polypeptides are provided herein.

Exemplary nucleic acids encoding Cas9 molecules or Cas9 polypeptides are described in Cong et al., SCIENCE 2013, 399(6121):819-823; Wang et al., CELL 2013, 153(4):910-918; Mali et al., SCIENCE 2013, 399(6121):823-826; Jinek et al., SCIENCE 2012, 337(6096):816-821. Another exemplary nucleic acid encoding a Cas9 molecule or Cas9 polypeptide is shown in FIG. 8.

In an embodiment, a nucleic acid encoding a Cas9 molecule or Cas9 polypeptide can be a synthetic nucleic acid sequence. For example, the synthetic nucleic acid molecule can be chemically modified, e.g., as described in Section VIII. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

Provided below is an exemplary codon optimized nucleic acid sequence encoding a Cas9 molecule of S. pyogenes.

(SEQ ID NO: 22)
```
ATGGATAAAA AGTACAGCAT CGGGCTGGAC ATCGGTACAA

ACTCAGTGGG GTGGGCCGTG ATTACGGACG AGTACAAGGT

ACCCTCCAAA AAATTTAAAG TGCTGGGTAA CACGGACAGA

CACTCTATAA AGAAAAATCT TATTGGAGCC TTGCTGTTCG

ACTCAGGCGA GACAGCCGAA GCCACAAGGT TGAAGCGGAC

CGCCAGGAGG CGGTATACCA GGAGAAAGAA CCGCATATGC

TACCTGCAAG AAATCTTCAG TAACGAGATG GCAAAGGTTG

ACGATAGCTT TTTCCATCGC CTGGAAGAAT CCTTTCTTGT

TGAGGAAGAC AAGAAGCACG AACGGCACCC CATCTTTGGC

AATATTGTCG ACGAAGTGGC ATATCACGAA AAGTACCCGA

CTATCTACCA CCTCAGGAAG AAGCTGGTGG ACTCTACCGA

TAAGGCGGAC CTCAGACTTA TTTATTTGGC ACTCGCCCAC

ATGATTAAAT TTAGAGGACA TTTCTTGATC GAGGGCGACC
```

```
TGAACCCGGA CAACAGTGAC GTCGATAAGC TGTTCATCCA
ACTTGTGCAG ACCTACAATC AACTGTTCGA AGAAAACCCT
ATAAATGCTT CAGGAGTCGA CGCTAAAGCA ATCCTGTCCG
CGCGCCTCTC AAAATCTAGA AGACTTGAGA ATCTGATTGC
TCAGTTGCCC GGGGAAAAGA AAAATGGATT GTTTGGCAAC
CTGATCGCCC TCAGTCTCGG ACTGACCCCA AATTTCAAAA
GTAACTTCGA CCTGGCCGAA GACGCTAAGC TCCAGCTGTC
CAAGGACACA TACGATGACG ACCTCGACAA TCTGCTGGCC
CAGATTGGGG ATCAGTACGC CGATCTCTTT TTGGCAGCAA
AGAACCTGTC CGACGCCATC CTGTTGAGCG ATATCTTGAG
AGTGAACACC GAAATTACTA AGCACCCCT TAGCGCATCT
ATGATCAAGC GGTACGACGA GCATCATCAG GATCTGACCC
TGCTGAAGGC TCTTGTGAGG CAACAGCTCC CCGAAAAATA
CAAGGAAATC TTCTTTGACC AGAGCAAAAA CGGCTACGCT
GGCTATATAG ATGGTGGGGC CAGTCAGGAG GAATTCTATA
AATTCATCAA GCCCATTCTC GAGAAAATGG ACGGCACAGA
GGAGTTGCTG GTCAAACTTA ACAGGGAGGA CCTGCTGCGG
AAGCAGCGGA CCTTTGACAA CGGGTCTATC CCCCACCAGA
TTCATCTGGG CGAACTGCAC GCAATCCTGA GGAGGCAGGA
GGATTTTTAT CCTTTTCTTA AAGATAACCG CGAGAAAATA
GAAAAGATTC TTACATTCAG GATCCCGTAC TACGTGGGAC
CTCTCGCCCG GGGCAATTCA CGGTTTGCCT GGATGACAAG
GAAGTCAGAG GAGACTATTA CACCTTGGAA CTTCGAAGAA
GTGGTGGACA AGGGTGCATC TGCCCAGTCT TTCATCGAGC
GGATGACAAA TTTTGACAAG AACCTCCCTA ATGAGAAGGT
GCTGCCCAAA CATTCTCTGC TCTACGAGTA CTTTACCGTC
TACAATGAAC TGACTAAAGT CAAGTACGTC ACCGAGGGAA
TGAGGAAGCC GGCATTCCTT AGTGGAGAAC AGAAGAAGGC
GATTGTAGAC CTGTTGTTCA AGACCAACAG GAAGGTGACT
GTGAAGCAAC TTAAAGAAGA CTACTTTAAG AAGATCGAAT
GTTTTGACAG TGTGGAAATT TCAGGGGTTG AAGACCGCTT
CAATGCGTCA TTGGGGACTT ACCATGATCT TCTCAAGATC
ATAAAGGACA AAGCTTCCT GGACAACGAA GAAAATGAGG
ATATTCTCGA AGACATCGTC CTCACCCTGA CCCTGTTCGA
AGACAGGGAA ATGATAGAAG AGCGCTTGAA AACCTATGCC
CACCTCTTCG ACGATAAAGT TATGAAGCAG CTGAAGCGCA
GGAGATACAC AGGATGGGGA AGATTGTCAA GGAAGCTGAT
CAATGGAATT AGGGATAAAC AGAGTGGCAA GACCATACTG
GATTTCCTCA AATCTGATGG CTTCGCCAAT AGGAACTTCA
TGCAACTGAT TCACGATGAC TCTCTTACCT TCAAGGAGGA
CATTCAAAAG GCTCAGGTGA GCGGGCAGGG AGACTCCCTT
CATGAACACA TCGCGAATTT GGCAGGTTCC CCCGCTATTA
AAAAGGGCAT CCTTCAAACT GTCAAGGTGG TGGATGAATT
GGTCAAGGTA ATGGGCAGAC ATAAGCCAGA AAATATTGTG
ATCGAGATGG CCCGCGAAAA CCAGACCACA CAGAAGGGCC
AGAAAATAG TAGAGAGCGG ATGAAGAGGA TCGAGGAGGG
CATCAAAGAG CTGGGATCTC AGATTCTCAA AGAACACCCC
GTAGAAAACA CACAGCTGCA GAACGAAAAA TTGTACTTGT
ACTATCTGCA GAACGGCAGA GACATGTACG TCGACCAAGA
ACTTGATATT AATAGACTGT CCGACTATGA CGTAGACCAT
ATCGTGCCCC AGTCCTTCCT GAAGGACGAC TCCATTGATA
ACAAAGTCTT GACAAGAAGC GACAAGAACA GGGGTAAAAG
TGATAATGTG CCTAGCGAGG AGGTGGTGAA AAAAATGAAG
AACTACTGGC GACAGCTGCT TAATGCAAAG CTCATTACAC
AACGGAAGTT CGATAATCTG ACGAAAGCAG AGAGAGGTGG
CTTGTCTGAG TTGGACAAGG CAGGGTTTAT TAAGCGGCAG
CTGGTGGAAA CTAGGCAGAT CACAAAGCAC GTGGCGCAGA
TTTTGGACAG CCGGATGAAC ACAAAATACG ACGAAAATGA
TAAACTGATA CGAGAGGTCA AAGTTATCAC GCTGAAAAGC
AAGCTGGTGT CCGATTTTCG GAAAGACTTC CAGTTCTACA
AAGTTCGCGA GATTAATAAC TACCATCATG CTCACGATGC
GTACCTGAAC GCTGTTGTCG GGACCGCCTT GATAAAGAAG
TACCCAAAGC TGGAATCCGA GTTCGTATAC GGGGATTACA
AAGTGTACGA TGTGAGGAAA ATGATAGCCA AGTCCGAGCA
GGAGATTGGA AAGGCCACAC TAAGTACTT CTTTTATTCT
AACATCATGA ATTTTTTTAA GACGGAAATT ACCCTGGCCA
ACGGAGAGAT CAGAAAGCGG CCCCTTATAG AGACAAATGG
TGAAACAGGT GAAATCGTCT GGGATAAGGG CAGGGATTTC
GCTACTGTGA GGAAGGTGCT GAGTATGCCA CAGGTAAATA
TCGTGAAAAA AACCGAAGTA CAGACCGGAG GATTTTCCAA
GGAAAGCATT TTGCCTAAAA GAAACTCAGA CAAGCTCATC
GCCCGCAAGA AAGATTGGGA CCCTAAGAAA TACGGGGGAT
TTGACTCACC CACCGTAGCC TATTCTGTGC TGGTGGTAGC
TAAGGTGGAA AAAGGAAAGT CTAAGAAGCT GAAGTCCGTG
AAGGAACTCT TGGGAATCAC TATCATGGAA AGATCATCCT
TTGAAAAGAA CCCTATCGAT TTCCTGGAGG CTAAGGGTTA
CAAGGAGGTC AAGAAAGACC TCATCATTAA ACTGCCAAAA
TACTCTCTCT TCGAGCTGGA AAATGGCAGG AAGAGAATGT
TGGCCAGCGC CGGAGAGCTG CAAAAGGGAA ACGAGCTTGC
TCTGCCCTCC AAATATGTTA ATTTTCTCTA TCTCGCTTCC
CACTATGAAA AGCTGAAAGG GTCTCCCGAA GATAACGAGC
```

```
AGAAGCAGCT GTTCGTCGAA CAGCACAAGC ACTATCTGGA

TGAAATAATC GAACAAATAA GCGAGTTCAG CAAAAGGGTT

ATCCTGGCGG ATGCTAATTT GGACAAAGTA CTGTCTGCTT

ATAACAAGCA CCGGGATAAG CCTATTAGGG AACAAGCCGA

GAATATAATT CACCTCTTTA CACTCACGAA TCTCGGAGCC

CCCGCCGCCT TCAAATACTT TGATACGACT ATCGACCGGA

AACGGTATAC CAGTACCAAA GAGGTCCTCG ATGCCACCCT

CATCCACCAG TCAATTACTG GCCTGTACGA AACACGGATC

GACCTCTCTC AACTGGGCGG CGACTAG
```

Provided below is the corresponding amino acid sequence of a *S. pyogenes* Cas9 molecule.

```
                                              (SEQ ID NO: 7)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD*
```

Provided below is an exemplary codon optimized nucleic acid sequence encoding a Cas9 molecule of *N. meningitidis*.

```
                                              (SEQ ID NO: 24)
ATGGCCGCCTTCAAGCCCAACCCCATCAACTACATCCTGGGCCTGGACAT

CGGCATCGCCAGCGTGGGCTGGGCCATGGTGGAGATCGACGAGGACGAGA

ACCCCATCTGCCTGATCGACCTGGGTGTGCGCGTGTTCGAGCGCGCTGAG

GTGCCCAAGACTGGTGACAGTCTGGCTATGGCTCGCCGGCTTGCTCGCTC

TGTTCGGCGCCTTACTCGCCGGCGCGCTCACCGCCTTCTGCGCGCTCGCC

GCCTGCTGAAGCGCGAGGGTGTGCTGCAGGCTGCCGACTTCGACGAGAAC

GGCCTGATCAAGAGCCTGCCCAACACTCCTTGGCAGCTGCGCGCTGCCGC

TCTGGACCGCAAGCTGACTCCTCTGGAGTGGAGCGCCGTGCTGCTGCACC

TGATCAAGCACCGCGGCTACCTGAGCCAGCGCAAGAACGAGGGCGAGACC

GCCGACAAGGAGCTGGGTGCTCTGCTGAAGGGCGTGGCCGACAACGCCCA

CGCCCTGCAGACTGGTGACTTCCGCACTCCTGCTGAGCTGGCCCTGAACA

AGTTCGAGAAGGAGAGCGGCCACATCCGCAACCAGCGCGGCGACTACAGC

CACACCTTCAGCCGCAAGGACCTGCAGGCCGAGCTGATCCTGCTGTTCGA

GAAGCAGAAGGAGTTCGGCAACCCCCACGTGAGCGGCGGCCTGAAGGAGG

GCATCGAGACCCTGCTGATGACCCAGCGCCCCGCCCTGAGCGGCGACGCC

GTGCAGAAGATGCTGGGCCACTGCACCTTCGAGCCAGCCGAGCCCAAGGC

CGCCAAGAACACCTACACCGCCGAGCGCTTCATCTGGCTGACCAAGCTGA

ACAACCTGCGCATCCTGGAGCAGGGCAGCGAGCGCCCCCTGACCGACACC

GAGCGCGCCACCCTGATGGACGAGCCCTACCGCAAGAGCAAGCTGACCTA

CGCCCAGGCCCGCAAGCTGCTGGGTCTGGAGGACACCGCCTTCTTCAAGG

GCCTGCGCTACGGCAAGGACAACGCCGAGGCCAGCACCCTGATGGAGATG

AAGGCCTACCACGCCATCAGCCGCGCCCTGGAGAAGGAGGGCCTGAAGGA

CAAGAAGAGTCCTCTGAACCTGAGCCCCGAGCTGCAGGACGAGATCGGCA

CCGCCTTCAGCCTGTTCAAGACCGACGAGGACATCACCGGCCGCCTGAAG

GACCGCATCCAGCCCGAGATCCTGGAGGCCCTGCTGAAGCACATCAGCTT

CGACAAGTTCGTGCAGATCAGCCTGAAGGCCCTGCGCCGCATCGTGCCCC

TGATGGAGCAGGGCAAGCGCTACGACGAGGCCTGCGCCGAGATCTACGGC

GACCACTACGGCAAGAAGAACACCGAGGAGAAGATCTACCTGCCTCCTAT

CCCCGCCGACGAGATCCGCAACCCCGTGGTGCTGCGCGCCCTGAGCCAGG

CCCGCAAGGTGATCAACGGCGTGGTGCGCCGCTACGGCAGCCCCGCCCGC

ATCCACATCGAGACCGCCCGCGAGGTGGGCAAGAGCTTCAAGGACCGCAA

GGAGATCGAGAAGCGCCAGGAGGAGAACCGCAAGGACCGCGAGAAGGCCG

CCGCCAAGTTCCGCGAGTACTTCCCCAACTTCGTGGGCGAGCCCAAGAGC

AAGGACATCCTGAAGCTGCGCCTGTACGAGCAGCAGCACGGCAAGTGCCT

GTACAGCGGCAAGGAGATCAACCTGGGCCGCCTGAACGAGAAGGGCTACG

TGGAGATCGACCACGCCCTGCCCTTCAGCCGCACCTGGGACGACAGCTTC

AACAACAAGGTGCTGGTGCTGGGCAGCGAGAACCAGAACAAGGGCAACCA

GACCCCCTACGAGTACTTCAACGGCAAGGACAACAGCCGCGAGTGGCAGG
```

```
AGTTCAAGGCCCGCGTGGAGACCAGCCGCTTCCCCCGCAGCAAGAAGCAG
CGCATCCTGCTGCAGAAGTTCGACGAGGACGGCTTCAAGGAGCGCAACCT
GAACGACACCCGCTACGTGAACCGCTTCCTGTGCCAGTTCGTGGCCGACC
GCATGCGCCTGACCGGCAAGGGCAAGAAGCGCGTGTTCGCCAGCAACGGC
CAGATCACCAACCTGCTGCGCGGCTTCTGGGGCCTGCGCAAGGTGCGCGC
CGAGAACGACCGCCACCACGCCCTGGACGCCGTGGTGGTGGCCTGCAGCA
CCGTGGCCATGCAGCAGAAGATCACCCGCTTCGTGCGCTACAAGGAGATG
AACGCCTTCGACGGTAAAACCATCGACAAGGAGACCGGCGAGGTGCTGCA
CCAGAAGACCCACTTCCCCCAGCCCTGGGAGTTCTTCGCCCAGGAGGTGA
TGATCCGCGTGTTCGGCAAGCCCGACGGCAAGCCCGAGTTCGAGGAGGCC
GACACCCCCGAGAAGCTGCGCACCCTGCTGGCCGAGAAGCTGAGCAGCCG
CCCTGAGGCCGTGCACGAGTACGTGACTCCTCTGTTCGTGAGCCGCGCCC
CCAACCGCAAGATGAGCGGTCAGGGTCACATGGAGACCGTGAAGAGCGCC
AAGCGCCTGGACGAGGGCGTGAGCGTGCTGCGCGTGCCCCTGACCCAGCT
GAAGCTGAAGGACCTGGAGAAGATGGTGAACCGCGAGCGCGAGCCCAAGC
TGTACGAGGCCCTGAAGGCCCGCCTGGAGGCCCACAAGGACGACCCCGCC
AAGGCCTTCGCCGAGCCCTTCTACAAGTACGACAAGGCCGGCAACCGCAC
CCAGCAGGTGAAGGCCGTGCGCGTGGAGCAGGTGCAGAAGACCGGCGTGT
GGGTGCGCAACCACAACGGCATCGCCGACAACGCCACCATGGTGCGCGTG
GACGTGTTCGAGAAGGGCGACAAGTACTACCTGGTGCCCATCTACAGCTG
GCAGGTGGCCAAGGGCATCCTGCCCGACCGCGCCGTGGTGCAGGGCAAGG
ACGAGGAGGACTGGCAGCTGATCGACGACAGCTTCAACTTCAAGTTCAGC
CTGCACCCCAACGACCTGGTGGAGGTGATCACCAAGAAGGCCCGCATGTT
CGGCTACTTCGCCAGCTGCCACCGCGGCACCGGCAACATCAACATCCGCA
TCCACGACCTGGACCACAAGATCGGCAAGAACGGCATCCTGGAGGGCATC
GGCGTGAAGACCGCCCTGAGCTTCCAGAAGTACCAGATCGACGAGCTGGG
CAAGGAGATCCGCCCCTGCCGCCTGAAGAAGCGCCCTCCTGTGCGCTAA
```

Provided below is the corresponding amino acid sequence of a *N. meningitidis* Cas9 molecule.

```
                                            (SEQ ID NO: 25)
MAAFKPNPINYILGLDIGIASVGWAMVEIDEDENPICLIDLGVRVFERAE
VPKTGDSLAMARRLARSVRRLTRRRAHRLLRARRLLKREGVLQAADFDEN
GLIKSLPNTPWQLRAAALDRKLTPLEWSAVLLHLIKHRGYLSQRKNEGET
ADKELGALLKGVADNAHALQTGDFRTPAELALNKFEKESGHIRNQRGDYS
HTFSRKDLQAELILLFEKQKEFGNPHVSGGLKEGIETLLMTQRPALSGDA
VQKMLGHCTFEPAEPKAAKNTYTAERFIWLTKLNNLRILEQGSERPLTDT
ERATLMDEPYRKSKLTYAQARKLLGLEDTAFFKGLRYGKDNAEASTLMEM
KAYHAISRALEKEGLKDKKSPLNLSPELQDEIGTAFSLFKTDEDITGRLK
DRIQPEILEALLKHISFDKFVQISLKALRRIVPLMEQGKRYDEACAEIYG
DHYGKKNTEEKIYLPPIPADEIRNPVVLRALSQARKVINGVVRRYGSPAR
IHIETAREVGKSFKDRKEIEKRQEENRKDREKAAAKFREYFPNFVGEPKS
KDILKLRLYEQQHGKCLYSGKEINLGRLNEKGYVEIDHALPFSRTWDDSF
NNKVLVLGSENQNKGNQTPYEYFNGKDNSREWQEFKARVETSRFPRSKKQ
RILLQKFDEDGFKERNLNDTRYVNRFLCQFVADRMRLTGKGKKRVFASNG
QITNLLRGFWGLRKVRAENDRHHALDAVVVACSTVAMQQKITRFVRYKEM
NAFDGKTIDKETGEVLHQKTHFPQPWEFFAQEVMIRVFGKPDGKPEFEEA
DTPEKLRTLLAEKLSSRPEAVHEYVTPLFVSRAPNRKMSGQGHMETVKSA
KRLDEGVSVLRVPLTQLKLKDLEKMVNREREPKLYEALKARLEAHKDDPA
KAFAEPFYKYDKAGNRTQQVKAVRVEQVQKTGVWVRNHNGIADNATMVRV
DVFEKGDKYYLVPIYSWQVAKGILPDRAVVQGKDEEDWQLIDDSFNFKFS
LHPNDLVEVITKKARMFGYFASCHRGTGNINIRIHDLDHKIGKNGILEGI
GVKTALSFQKYQIDELGKEIRPCRLKKRPPVR*
```

Provided below is an amino acid sequence of a *S. aureus* Cas9 molecule.

```
                                            (SEQ ID NO: 26)
MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFFEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG*
```

Provided below is an exemplary codon optimized nucleic acid sequence encoding a Cas9 molecule of S. aureus Cas9.

(SEQ ID NO: 39)
ATGAAAAGGAACTACATTCTGGGGCTGGACATCGGGATTACAAGCGTGGG

GTATGGGATTATTGACTATGAAACAAGGGACGTGATCGACGCAGGCGTCA

GACTGTTCAAGGAGGCCAACGTGGAAAACAATGAGGGACGGAGAAGCAAG

AGGGGAGCCAGGCGCCTGAAACGACGGAGAAGGCACAGAATCCAGAGGGT

GAAGAAACTGCTGTTCGATTACAACCTGCTGACCGACCATTCTGAGCTGA

GTGGAATTAATCCTTATGAAGCCAGGGTGAAAGGCCTGAGTCAGAAGCTG

TCAGAGGAAGAGTTTTCCGCAGCTCTGCTGCACCTGGCTAAGCGCCGAGG

AGTGCATAACGTCAATGAGGTGGAAGAGGACACCGGCAACGAGCTGTCTA

CAAAGGAACAGATCTCACGCAATAGCAAAGCTCTGGAAGAGAAGTATGTC

GCAGAGCTGCAGCTGGAACGGCTGAAGAAAGATGGCGAGGTGAGAGGGTC

AATTAATAGGTTCAAGACAAGCGACTACGTCAAAGAAGCCAAGCAGCTGC

TGAAAGTGCAGAAGGCTTACCACCAGCTGGATCAGAGCTTCATCGATACT

TATATCGACCTGCTGGAGACTCGGAGAACCTACTATGAGGGACCAGGAGA

AGGGAGCCCCTTCGGATGGAAAGACATCAAGGAATGGTACGAGATGCTGA

TGGGACATTGCACCTATTTTCCAGAAGAGCTGAGAAGCGTCAAGTACGCT

TATAACGCAGATCTGTACAACGCCCTGAATGACCTGAACAACCTGGTCAT

CACCCAGGGATGAAAACGAGAAACTGGAATACTATGAGAAGTTCCAGATCA

TCGAAAACGTGTTTAAGCAGAAGAAAAAGCCTACACTGAAACAGATTGCT

AAGGAGATCCTGGTCAACGAAGAGGACATCAAGGGCTACCGGGTGACAAG

CACTGGAAAACCAGAGTTCACCAATCTGAAAGTGTATCACGATATTAAGG

ACATCACAGCACGGAAAGAAATCATTGAGAACGCCGAACTGCTGGATCAG

ATTGCTAAGATCCTGACTATCTACCAGAGCTCCGAGGACATCCAGGAAGA

GCTGACTAACCTGAACAGCGAGCTGACCCAGGAAGAGATCGAACAGATTA

GTAATCTGAAGGGGTACACCGGAACACACAACCTGTCCCTGAAAGCTATC

AATCTGATTCTGGATGAGCTGTGGCATACAAACGACAATCAGATTGCAAT

CTTTAACCGGCTGAAGCTGGTCCCAAAAAAGGTGGACCTGAGTCAGCAGA

AAGAGATCCCAACCACACTGGTGGACGATTTCATTCTGTCACCCGTGGTC

AAGCGGAGCTTCATCCAGAGCATCAAAGTGATCAACGCCATCATCAAGAA

GTACGGCCTGCCCAATGATATCATTATCGAGCTGGCTAGGGAGAAGAACA

GCAAGGACGCACAGAAGATGATCAATGAGATGCAGAAACGAAACCGGCAG

ACCAATGAACGCATTGAAGAGATTATCCGAACTACCGGGAAAGAGAACGC

AAAGTACCTGATTGAAAAAATCAAGCTGCACGATATGCAGGAGGGAAAGT

GTCTGTATTCTCTGGAGGCCATCCCCCTGGAGGACCTGCTGAACAATCCA

TTCAACTACGAGGTCGATCATATTATCCCCAGAAGCGTGTCCTTCGACAA

TTCCTTTAACAACAAGGTGCTGGTCAAGCAGGAAGAGAACTCTAAAAAGG

GCAATAGGACTCCTTTCCAGTACCTGTCTAGTTCAGATTCCAAGATCTCT

TACGAAACCTTTAAAAAGCACATTCTGAATCTGGCCAAAGGAAAGGGCCG

CATCAGCAAGACCAAAAAGGAGTACCTGCTGGAAGAGCGGGACATCAACA

-continued
GATTCTCCGTCCAGAAGGATTTTATTAACCGGAATCTGGTGGACACAAGA

TACGCTACTCGCGGCCTGATGAATCTGCTGCGATCCTATTTCCGGGTGAA

CAATCTGGATGTGAAAGTCAAGTCCATCAACGGCGGGTTCACATCTTTTC

TGAGGCGCAAATGGAAGTTTAAAAAGGAGCGCAACAAAGGGTACAAGCAC

CATGCCGAAGATGCTCTGATTATCGCAAATGCCGACTTCATCTTTAAGGA

GTGGAAAAAGCTGGACAAAGCCAAGAAAGTGATGGAGAACCAGATGTTCG

AAGAGAAGCAGGCCGAATCTATGCCCGAAATCGAGACAGAACAGGAGTAC

AAGGAGATTTTCATCACTCCTCACCAGATCAAGCATATCAAGGATTTCAA

GGACTACAAGTACTCTCACCGGGTGGATAAAAAGCCCAACAGAGAGCTGA

TCAATGACACCCTGTATAGTACAAGAAAAGACGATAAGGGGAATACCCTG

ATTGTGAACAATCTGAACGGACTGTACGACAAAGATAATGACAAGCTGAA

AAAGCTGATCAACAAAAGTCCCGAGAAGCTGCTGATGTACCACCATGATC

CTCAGACATATCAGAAACTGAAGCTGATTATGGAGCAGTACGGCGACGAG

AAGAACCCACTGTATAAGTACTATGAAGAGACTGGGAACTACCTGACCAA

GTATAGCAAAAGGATAATGGCCCCGTGATCAAGAAGATCAAGTACTATG

GGAACAAGCTGAATGCCCATCTGGACATCACAGACGATTACCCTAACAGT

CGCAACAAGGTGGTCAAGCTGTCACTGAAGCCATACAGATTCGATGTCTA

TCTGGACAACGGCGTGTATAAATTTGTGACTGTCAAGAATCTGGATGTCA

TCAAAAAGGAGAACTACTATGAAGTGAATAGCAAGTGCTACGAAGAGGCT

AAAAAGCTGAAAAAGATTAGCAACCAGGCAGAGTTCATCGCCTCCTTTTA

CAACAACGACCTGATTAAGATCAATGGCGAACTGTATAGGGTCATCGGGG

TGAACAATGATCTGCTGAACCGCATTGAAGTGAATATGATTGACATCACT

TACCGAGAGTATCTGGAAAACATGAATGATAAGCGCCCCCCTCGAATTAT

CAAAACAATTGCCTCTAAGACTCAGAGTATCAAAAAGTACTCAACCGACA

TTCTGGGAAACCTGTATGAGGTGAAGAGCAAAAAGCACCCTCAGATTATC

AAAAAGGGC

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al., PLoS COMPUTATIONAL BIOLOGY 2005, 1(6): e60 and Makarova et al., NATURE REVIEW MICROBIOLOGY 2011, 9:467-477, the contents of both references are incorporated herein by reference in their entirety. Exemplary Cas molecules (and Cas systems) are also shown in Table 12.

TABLE 12

Cas Systems

| Gene name[‡] | System type or subtype | Name from Haft et al.[§] | Structure of encoded protein (PDB accessions)[¶] | Families (and superfamily) of encoded protein[#**] | Representatives |
|---|---|---|---|---|---|
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |
| cas8a2 | Subtype I-A[‡‡] | csa4 and csx9 | NA | PH0918 | AF0070, AF1873, MJ0385, PF0637, PH0918 and SSO1401 |
| cas8b | Subtype I-B[‡‡] | csh1 and TM1802 | NA | BH0338-like | MTH1090 and TM1802 |
| cas8c | Subtype I-C[‡‡] | csd1 and csp2 | NA | BH0338-like | BH0338 |
| cas9 | Type II[‡‡] | csn1 and csx12 | NA | COG3513 | FTN_0757 and SPy1046 |
| cas10 | Type III[‡‡] | cmr2, csm1 and csx11 | NA | COG1353 | MTH326, Rv2823c[§§] and TM1794[§§] |
| cas10d | Subtype I-D[‡‡] | csc3 | NA | COG1353 | slr7011 |
| csy1 | Subtype I-F[‡‡] | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E[‡‡] | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A[‡‡] | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |

TABLE 12-continued

Cas Systems

| Gene name[‡] | System type or subtype | Name from Haft et al.[§] | Structure of encoded protein (PDB accessions)[¶] | Families (and superfamily) of encoded protein[#,**] | Representatives |
|---|---|---|---|---|---|
| cmr5 | Subtype III-B[‡‡] | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U[§§] | NA | NA | (RAMP) | Balac_1305 and GSU0054 |
| csb3 | Subtype I-U | NA | NA | (RAMP) | Balac_1303[§§] |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

IV. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule are described, e.g., in Jinek et al., SCIENCE 2012, 337(6096):816-821.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM MgCl$_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min, in a 50 µL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 µl. Reactions are initiated by the addition of 1 µl target DNA (10 nM) and incubated for 1 h at 37° C. Reactions are quenched by the addition of 20 µl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA are described, e.g., in Jinek et al., SCIENCE 2012; 337(6096):816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated H$_2$O. Eluted DNA is ethanol precipitated and dissolved in DEPC-treated H$_2$O. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM MgCl$_2$, 1 mM DTT and 10% glycerol in a total volume of 10 µl. Cas9 protein molecule is programmed with equimolar amounts of pre-annealed gRNA molecule and titrated from 100 µM to 1 µM. Radiolabeled DNA is added to a final concentration of 20 µM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10×SYPRO Orange® (Life Techonologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer+10×SYPRO Orange® (Life Techonologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

V. Genome Editing Approaches

Mutations in the USH2A gene may be corrected using one of the approaches discussed herein. In an embodiment, a mutation in the USH2A gene is corrected by homology directed repair (HDR) using an exogenously provided template nucleic acid (see Section V.1).

V.1 HDR Repair and Template Nucleic Acids

The donor template or template nucleic acid provides for alteration of the target sequence. While not wishing to be bound by theory, it is believed that alteration of the target sequence occurs by homology-directed repair (HDR) with the donor template. While not wishing to be bound by theory, it is believed that plasmid donors serve as templates for homologous recombination and it is believed that single stranded donor templates provide for alteration of the target sequence potentially by alternate methods of homology directed repair (e.g., single strand annealing) between the target sequence and the donor template. Donor template-effected alteration of a target sequence depends on cleavage by a Cas9 molecule. Cleavage by Cas9 can comprise a double strand break or two single strand breaks.

Double Strand Break Mediated Correction

In an embodiment, double strand cleavage is effected by a Cas9 molecule having cleavage activity associated with an HNH-like domain and cleavage activity associated with anRuvC-like domain, e.g., an N-terminal RuvC-like domain, e.g., a wildtype Cas9. Such embodiments require only a single gRNA.

Single Strand Break Mediated Correction

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments require two gRNAs, one for placement of each single strand break. In an embodiment, the Cas9 molecule having nickase activity cleaves the strand to which the gRNA hybridizes but not the strand that is complementary to the strand to which the gRNA hybridizes. In an embodiment, the Cas9 molecule having nickase activity does not cleave the strand to which the gRNA hybridizes but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC therefore the Cas9 nickase has (only) HNH activity and will cut on the strand to which the gRNA hybridizes (the complementary strand, which does not have the NGG PAM on it). In other embodiments, a Cas9 molecule having an H840, e.g., an H840A, mutation can be used as a nickase. H840A inactivates HNH therefore the Cas9 nickase has (only) RuvC activity and cuts on the non-complementary strand (the strand that has the NGG PAM and whose sequence is identical to the gRNA). In other embodiments, a Cas9 molecule having an H863, e.g., an H863A, mutation can be used as a nickase. H863A inactivates HNH therefore the Cas9 nickase has (only) RuvC activity and cuts on the non-complementary strand (the strand that has the NGG PAM and whose sequence is identical to the gRNA).

In an embodiment, in which a nickase and two gRNAs are used to position two single strand nicks, one nick is on the + strand and one nick is on the − strand of the target nucleic acid. The PAMs can be outwardly facing. The gRNAs can be selected such that the gRNAs are separated by, from 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran et al., Cell 2013; 154(6): 1380-1389).

In an embodiment, a single nick can be used to induce HDR. In an embodiment, using a single nick to induce HDR is less efficient and has a lower on-target activity than is seen with a double nickase approach.

Placement of Double Strand or Single Strand Breaks Relative to the Target Position The double strand break or single strand break in one of the strands should be sufficiently close to the target sequence or signature such that correction occurs. In an embodiment, the distance is not more than 50, 100, 200, 300, 350 or 400 nucleotides. While not wishing to be bound by theory, it is believed that the break should be sufficiently close to the target sequence such that the break is within the region that is subject to exonuclease-mediated removal during end resection. If the distance between the target sequence and a break is too great, the mutation may not be included in the end resection and, therefore, may not be corrected, as donor sequence may only be used to correct sequence within the end resection region.

In an embodiment, a gRNA, e.g., a unimolecular (or chimeric) or modular gRNA molecule, is configured to position one double-strand break in close proximity to a nucleotide of the target position. In an embodiment, the cleavage site is between 0-40 bp away from the target position (e.g., less than 40, 35, 30, 25, 20, 15, 10, 9, 8, 7, 6, 5, 4, 3, 2 or 1 bp from the target position).

In an embodiment, two gRNAs, e.g., independently, unimolecular (or chimeric) or modular gRNA, are configured to position two single-strand breaks. In an embodiment, the gRNAs are configured to position cuts at the same position, or within a few nucleotides of one another, on different strands, essentially mimicking a double strand break. In an embodiment, the two nicks are between 0-40 bp away from the target position (e.g., less than 40, 35, 30, 25, 20, 15, 10, 9, 8, 7, 6, 5, 4, 3, 2 or 1 bp from the target position) respectively, and the two single strand breaks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of the target position. In an embodiment, the gRNAs are configured to place a single strand break on the same side (either 5' or 3') of the target position.

Regardless of whether a break is a double strand or a single strand break, the gRNA should be configured to avoid unwanted target chromosome elements, such as repeated elements, e.g., an Alu repeat, in the target domain. In addition, a break, whether a double strand or a single strand break, should be sufficiently distant from any sequence that should not be altered. For example, cleavage sites positioned within introns should be sufficiently distant from any intron/exon border, or naturally occurring splice signal, to avoid alteration of the exonic sequence or unwanted splicing events.

Length of the Homology Arms

The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., Alu repeats.

Exemplary homology arm lengths include a least 50, 100, 250, 500, 750 or 1000 nucleotides.

Target position, as used herein, refers to a site on a target nucleic acid (e.g., the chromosome) that is modified by a Cas9 molecule-dependent process. For exampe, the target position can be a modified Cas9 molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or down stream of a target sequence (e.g., the sequence to which the gRNA binds).

A template nucleic acid, as that term is used herein, refers to a nucleic acid sequence which can be used in conjunction with a Cas9 molecule and a gRNA molecule to alter the structure of a target position. In an embodiment, the target nucleic acid is modified to have the some or all of the sequence of the template nucleic acid, typically at or near cleavage site(s). Target position, as used herein, refers to a nucleotide or nucleotides that are altered by the template nucleic acid, e.g., by altering, e.g., by recombination, e.g., homologous recombination or by homology directed repair. In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is singe stranded DNA. In an embodiment, the template nucleic acid is encoded on the same vector backbone, e.g. AAV genome, plasmid DNA, as the Cas9 and gRNA. In an embodiment, the template nucleic is excised from this backbone in vivo, e.g. is flanked by gRNA recognition sequences.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in the USH2A gene from can be used to alter the structure of a target sequence. The template sequence can be used to alter an unwanted structure, e.g., an unwanted or mutant nucleotide.

A template nucleic acid comprises the following components:

[5' Homology Arm]-[Replacement Sequence]-[3' Homology Arm].

The homology arms provide for recombination into the chromosome, thus replacing the undesired element, e.g., a mutation or signature, with the replacement sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, or 2000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, or 2000 nucleotides 3' from the 3' end of the replacement sequence.

Exemplary Template Nucleic Acids

Exemplary template nucleic acids (also referred to herein as donor constructs) to correction a mutation, e.g., a deletion of guanine at nucleotide position 2299 (2299delG) in the USH2A gene, are provided.

Suitable sequence for the 5' homology arm can be selected from (e.g., includes a portion of) or include the following sequence:

```
(5'H arm for 2299delG correction)
                                         (SEQ ID NO: 387)
AAAACATTTTTCTTCATTCGTAAAATGTATATGTGTACTCCTTTAAATAG

AAGTAATATAAAAAACAGAATTTACTTAGTGTTTAAAGAGGTATGTTCTG

AGTCACACAAGATGACAAGCAATGTGATTGCTTTATGAGCCAAGGAGAGC

ATGATTTATATTAATTGAAAATGATAAAATAGAGGAGCATACAAAAGGAT

TAAACCAAAAATTGCCCTGGATAAGTTTTATTTATATTAATTACTTAAAT

GTGTGGATTCAGAAATAAGTGTATATGCTGTTTTCACAAAAATAGTTATC

AGCTGACATTTTTTCTTTTTTCCCAGCTTCACGAAGGTATAATTAAATA

AAAATTGTATATATTTATGGCAGACAACATGATGTTTTGATATATGTACA

CATTATAAAATGATTAATTCCAGCTAATTAATGTATCCATCACCTCATGT

ACTTATCATGTTTTTGGGGTGAGAACATTTAAGATCTAATCTCTTAGCAA

TTTTCAAGTATACAATACATTATTATTAAGTATAGTCACCATGCTGTACA

ATAGAGCTCCAGAACTTATTCATTCTGTCTAGCTGAAACTTTGTACTCAG

CTTAACCTTTTATTAAACATCTTTAGAGATTTCTTATCTTTAGAAAAACA

ACTAATTTGTTATATGTAATTCTACTATAATTTTAAATGAGCACATTTGT

TAAAATAGTTTTTAAGATTTGTTAAAGAGAAAAAGAGCTCCAGCATATGT

AACAGAAACAACATTTGCATTAAGCATTTTTCTTTGCATTAAGTAATAAT

TAAAAATTTATGAAGTTCATCGCAAACAGTTGTATATTAAAGCTAAATTA

AATATTGTCATTGAATTTTGAGAGTAAGATTGGCCCCCTATGGCATTGCT

TGTGAGAAAACACTCAATATTTTGTGTTCGTATCATCTGCAGTAGCATTG

TTTGTGTCTCGTCTATCTTGAATGAAATCATTTTCCCATCCTCACCTTTT

AAATATATTTTATCTTTAGGGCTTAGGTGTGATCATTGCAATTTTGGATT

TAAATTTCTCCGAAGCTTTAATGATGTTGGATGTGAGCCCTGCCAGTGTA

ACCTCCATGGCTCAGTGAACAAATTCTGCAATCCTCACTCTGGGCAGTGT
```

Suitable sequence for the 3' homology arm can be selected from (e.g., includes a portion of) or include the following sequence:

```
(3'H arm for 2299delG correction)
                                         (SEQ ID NO: 388)
AGTGCAAAAAAGAAGCCAAAGGACTTCAGTGTGACACCTGCAGAGAAAAC

TTTTATGGGTTAGATGTCACCAATTGTAAGGCCTGTGACTGTGACACAGC

TGGATCCCTCCCTGGGACTGTCTGTAATGCTAAGACAGGGCAGTGCATCT
```

```
-continued
GCAAGCCCAATGTTGAAGGGAGACAGTGCAATAAATGTTTGGAGGGAAAC

TTCTACCTACGGCAAAATAATTCTTTCCTCTGTCTGCCTTGCAACTGTGA

TAAGACTGGGACAATAAATGGCTCTCTGCTGTGTAACAAATCAACAGGAC

AATGTCCTTGCAAATTAGGGGTAACAGGTCTTCGCTGTAATCAGTGTGAG

CCTCACAGGTACAATTTGACCATTGACAATTTTCAACACTGCCAGATGTG

TGAGTGTGATTCCTTGGGGACATTACCTGGGACCATTTGTGACCCAATCA

GTGGCCAGTGCCTGTGTGTGCCTAATCGTCAAGGAAGAAGGTGTAATCAG

TGTCAACCAGGTAAGAAAGAAATGTATTACATTTTCAGTGCACAATGACA

TTCCTTTTGTTAACTTAGGTAACTTCTCCCTGTTTCTGGTTTGTGGCTTC

TACAAATTTTATTTCCAAAATCATTACTGTATTTATATCATTATCCAACA

CATATATAACTATTTAACTTATTCAAAATTATCTGCATATTTATGTTACT

ATTTTGAGAGGATACTTTAGATAAAACTCAGCCGATCGGATTTATTTCAT

AATTGAGACTCAATTTCTACACTTGAAGTAAATCTCCTTTTTAACAGTTT

TTTAAAAATCAGATCAACAAGAGTCAATTTTATTTTCCAGAGAAAGGAAA

ATTTGAGTTGAATATCCATACAATGCCAAATATTCAAATGATGAACTAAA

TCTCTGAATAAAGCTGGCTAAATGTTTTTGCTGAAGAGGCTATATGTTCT

AGTTTTATATAGAAATACCTAGAATTGTTTCCACATGCCATCAAATTAAT

AAAATAGGCCACTGTTTAATCTCATTATATACAAACTTATCTTTCCATCT

CTTTCCCAATTGGGAGAGGGATAGACCCCATCTATGGCTCTCCTTACATT

TAAGATTTTAACTAAAATACTATACCTTCTTTACAATAAATTCATTATGA
```

In an embodiment, the replacement sequence comprises or consists of a guanine (G) residue.

In an embodiment, to correct a deletion of guanine at nucleotide position 2299 (2299delG) in the USH2A gene, the homology arms, e.g., the 5' and 3' homology arms, may each comprise about 1000 base pairs (bp) of sequence flanking the most distal gRNAs (e.g., 1150 bp of sequence on either side of the mutation). The 5' homology arm is shown as bold sequence, the inserted base to correct the guanine deletion is shown as non-bold and boxed sequence, and the 3' homology arm is shown as underlined sequence.

```
(Template Construct 1; SEQ ID NO: 389)
AAAACATTTTTCTTCATTCGTAAAATGTATATGTGTACTCCTTTAAATAG

AAGTAATATAAAAAACAGAATTTACTTAGTGTTTAAAGAGGTATGTTCTG

AGTCACACAAGATGACAAGCAATGTGATTGCTTTATGAGCCAAGGAGAGC

ATGATTTATATTAATTGAAAATGATAAAATAGAGGAGCATACAAAAGGAT

TAAACCAAAAATTGCCCTGGATAAGTTTTATTTATATTAATTACTTAAAT

GTGTGGATTCAGAAATAAGTGTATATGCTGTTTTCACAAAAATAGTTATC

AGCTGACATTTTTTCTTTTTTCCCAGCTTCACGAAGGTATAATTAAATA

AAAATTGTATATATTTATGGCAGACAACATGATGTTTTGATATATGTACA

CATTATAAAATGATTAATTCCAGCTAATTAATGTATCCATCACCTCATGT

ACTTATCATGTTTTTGGGGTGAGAACATTTAAGATCTAATCTCTTAGCAA

TTTTCAAGTATACAATACATTATTATTAAGTATAGTCACCATGCTGTACA

ATAGAGCTCCAGAACTTATTCATTCTGTCTAGCTGAAACTTTGTACTCAG
```

231

-continued
CTTAACCTTTTATTAAACATCTTTAGAGATTTCTTATCTTTAGAAAAACA

ACTAATTTGTTATATGTAATTCTACTATAATTTTAAATGAGCACATTTGT

TAAAATAGTTTTTAAGATTTGTTAAAGAGAAAAAGAGCTCCAGCATATGT

AACAGAAACAACATTTGCATTAAGCATTTTTCTTTGCATTAAGTAATAAT

TAAAAATTTATGAAGTTCATCGCAAACAGTTGTATATTAAAGCTAAATTA

AATATTGTCATTGAATTTTGAGAGTAAGATTGGCCCCCTATGGCATTGCT

TGTGAGAAAACACTCAATATTTTGTGTTCGTATCATCTGCAGTAGCATTG

TTTGTGTCTCGTCTATCTTGAATGAAATCATTTTCCCATCCTCACCTTTT

AAATATATTTTATCTTTAGGGCTTAGGTGTGATCATTGCAATTTTGGATT

TAAATTTCTCCGAAGCTTTAATGATGTTGGATGTGAGCCCTGCCAGTGTA

ACCTCCATGGCTCAGTGAACAAATTCTGCAATCCTCACTCTGGGCAGTGT

[G]AGTGCAAAAAGAAGCCAAAGGACTTCAGTGTGACACCTGCAGAGAAAA

CTTTTATGGGTTAGATGTCACCAATTGTAAGGCCTGTGACTGTGACACAG

CTGGATCCCTCCCTGGGACTGTCTGTAATGCTAAGACAGGGCAGTGCATC

TGCAAGCCCAATGTTGAAGGGAGACAGTGCAATAAATGTTTGGAGGGAAA

CTTCTACCTACGGCAAAATAATTCTTTCCTCTGTCTGCCTTGCAACTGTG

ATAAGACTGGGACAATAAATGGCTCTCTGCTGTGTAACAAATCAACAGGA

CAATGTCCTTGCAAATTAGGGGTAACAGGTCTTCGCTGTAATCAGTGTGA

GCCTCACAGGTACAATTTGACCATTGACAATTTTCAACACTGCCAGATGT

GTGAGTGTGATTCCTTGGGGACATTACCTGGGACCATTTGTGACCCAATC

AGTGGCCAGTGCCTGTGTGTGCCTAATCGTCAAGGAAGAAGGTGTAATCA

GTGTCAACCAGGTAAGAAAGAAATGTATTACATTTTCAGTGCACAATGAC

ATTCCTTTTGTTAACTTAGGTAACTTCTCCCTGTTTCTGGTTTGTGGCTT

CTACAAATTTTATTTCCAAAATCATTACTGTATTTATATCATTATCCAAC

ACATATATAACTATTTAACTTATTCAAAATTATCTGCATATTTATGTTAC

TATTTTGAGAGGATACTTTAGATAAAACTCAGCCGATCGGATTTATTTCA

TAATTGAGACTCAATTTCTACACTTGAAGTAAATCTCCTTTTTAACAGTT

TTTTAAAAATCAGATCAACAAGAGTCAATTTTATTTTCCAGAGAAAGGAA

AATTTGAGTTGAATATCCATACAATGCCAAATATTCAAATGATGAACTAA

ATCTCTGAATAAAGCTGGCTAAATGTTTTTGCTGAAGAGGCTATATGTTC

TAGTTTTATATAGAAATACCTAGAATTGTTTCCACATGCCATCAAATTAA

TAAAATAGGCCACTGTTTAATCTCATTATATACAAACTTATCTTTCCATC

TCTTTCCCAATTGGGAGAGGGATAGACCCCATCTATGGCTCTCCTTACAT

TTAAGATTTTAACTAAAATACTATACCTTCTTTACAATAAATTCATTATG

A

As described below in Table 13, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct a deletion of guanine at nucleotide position 2299 (2299delG) in the USH2A gene (i.e., insert the missing guanine at position 2299), the 5' homology arm may be shortened less than 600 nucleotides, e.g., approximately 550 nucleotides, i.e., 552 nucleotides, to avoid inclusion of a LINE repeat element in the 5' homology arm. An exemplary 5' homology arm is shown as bold sequence, the inserted base to correct the guanine deletion is shown as non-bold and boxed sequence, and an exemplary 3' homology arm is shown as underlined sequence.

(Template Construct 2; SEQ ID NO: 390)
AGCTTAACCTTTTATTAAACATCTTTAGAGATTTCTTATCTTTAGAAAAA

CAACTAATTTGTTATATGTAATTCTACTATAATTTTAAATGAGCACATTT

GTTAAAATAGTTTTTAAGATTTGTTAAAGAGAAAAAGAGCTCCAGCATAT

GTAACAGAAACAACATTTGCATTAAGCATTTTTCTTTGCATTAAGTAATA

ATTAAAAATTTATGAAGTTCATCGCAAACAGTTGTATATTAAAGCTAAAT

TAAATATTGTCATTGAATTTTGAGAGTAAGATTGGCCCCCTATGGCATTG

CTTGTGAGAAAACACTCAATATTTTGTGTTCGTATCATCTGCAGTAGCAT

TGTTTGTGTCTCGTCTATCTTGAATGAAATCATTTTCCCATCCTCACCTT

TTAAATATATTTTATCTTTAGGGCTTAGGTGTGATCATTGCAATTTTGGA

TTTAAATTTCTCCGAAGCTTTAATGATGTTGGATGTGAGCCCTGCCAGTG

TAACCTCCATGGCTCAGTGAACAAATTCTGCAATCCTCACTCTGGGCAGT

GT[G]AGTGCAAAAAGAAGCCAAAGGACTTCAGTGTGACACCTGCAGAGAA

AACTTTTATGGGTTAGATGTCACCAATTGTAAGGCCTGTGACTGTGACAC

AGCTGGATCCCTCCCTGGGACTGTCTGTAATGCTAAGACAGGGCAGTGCA

TCTGCAAGCCCAATGTTGAAGGGAGACAGTGCAATAAATGTTTGGAGGGA

AACTTCTACCTACGGCAAAATAATTCTTTCCTCTGTCTGCCTTGCAACTG

TGATAAGACTGGGACAATAAATGGCTCTCTGCTGTGTAACAAATCAACAG

GACAATGTCCTTGCAAATTAGGGGTAACAGGTCTTCGCTGTAATCAGTGT

GAGCCTCACAGGTACAATTTGACCATTGACAATTTTCAACACTGCCAGAT

GTGTGAGTGTGATTCCTTGGGGACATTACCTGGGACCATTTGTGACCCAA

TCAGTGGCCAGTGCCTGTGTGTGCCTAATCGTCAAGGAAGAAGGTGTAAT

CAGTGTCAACCAGGTAAGAAAGAAATGTATTACATTTTCAGTGCACAATG

ACATTCCTTTTGTTAACTTAGGTAACTTCTCCCTGTTTCTGGTTTGTGGC

TTCTACAAATTTTATTTCCAAAATCATTACTGTATTTATATCATTATCCA

ACACATATATAACTATTTAACTTATTCAAAATTATCTGCATATTTATGTT

ACTATTTTGAGAGGATACTTTAGATAAAACTCAGCCGATCGGATTTATTT

CATAATTGAGACTCAATTTCTACACTTGAAGTAAATCTCCTTTTTAACAG

TTTTTTAAAAATCAGATCAACAAGAGTCAATTTTATTTTCCAGAGAAAGG

AAAATTTGAGTTGAATATCCATACAATGCCAAATATTCAAATGATGAACT

AAATCTCTGAATAAAGCTGGCTAAATGTTTTTGCTGAAGAGGCTATATGT

TCTAGTTTTATATAGAAATACCTAGAATTGTTTCCACATGCCATCAAATT

-continued

AATAAAATAGGCCACTGTTTAATCTCATTATATACAAACTTATCTTTCCA

TCTCTTTCCCAATTGGGAGAGGGATAGACCCCATCTATGGCTCTCCTTAC

ATTTAAGATTTTAACTAAAATACTATACCTTCTTTACAATAAATTCATTA

TGA

It is contemplated herein that, in an embodiment, template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a deletion of guanine at nucleotide position 2299 (2299delG) in the USH2A gene (i.e., insert the missing guanine at position 2299). For example, the ssODN may include 50 bp 5' and 3' homology arms as shown below. The 5' homology arm is shown as bold sequence, the inserted base to correct the guanine deletion is shown as non-bold and boxed sequence, and the 3' homology arm is shown as underlined sequence.

(Template Construct 3; SEQ ID NO: 391)
ACCTCCATGGCTCAGTGAACAAATTCTGCAATCCTCACTCTGGGCAGTGT

G̲AGTGCAAAAAAGAAGCCAAAGGACTTCAGTGTGACACCTGCAGAGAAAAC

C

The table below provides exemplary template nucleotides. In an embodiment, the template nucleotide includes the 5' homology arm and the 3' homology arm of a row from this Table 13. In other embodiments, a 5' homology arm from the first column can be combined with a 3' homology arm from this Table. In each embodiment, the combination of the 5' and 3' homology arms include the replacement sequence, a guanine residue to correct the guanine deletion at position 2299 of USH2A.

It is contemplated herein that, in an embodiment, Cas9 could potentially cleave donor constructs either prior to or following homology directed repair (e.g., homologous recombination), resulting in a possible non-homologous-end-joining event and further DNA sequence mutation at the chromosomal locus of interest. Therefore, to avoid cleavage of the donor sequence before and/or after Cas9-mediated homology directed repair, alternate versions of the donor sequence may be used where silent mutations are introduced. These silent mutations may disrupt Cas9 binding and cleavage, but not disrupt the amino acid sequence of the repaired gene. For example, mutations may include those made to a donor sequence to repair the USH2A gene, the mutant form which can cause Usher Syndrome. If gRNA USH2A-179 with the 20-base target sequence GTTAGATGTCACCAATTGTA (SEQ ID NO:40; DNA sequence corresponding to RNA sequence of SEQ ID NO:393) is used with a donor construct to correct the 2299G deletion and the donor construct contains the sequence ACTTTTATGG GTTAGATGTCACCAATTGTAAGGCCTGTGACTG (SEQ ID NO:41), the donor sequence may be changed to ACTTTTATGGGGTTAGATGTCACCAATTGTAAAG-CCTGTGACTG (SEQ ID NO:941), where the bold A has been changed from a G at that position so that codon 793 still codes for the amino acid lysine, but the PAM sequence AGG has been modified to AAG to reduce or eliminate Cas9 cleavage at that locus.

TABLE 13

| 5' homology arm (the number of nucleotides from SEQ ID NO: 5'H, beginning at the 3' end of SEQ ID NO: 5'H) | Replacement Sequence = G | 3' homology arm (the number of nucleotides from SEQ ID NO: 3'H, beginning at the 5' end of SEQ ID NO: 3'H) |
|---|---|---|
| 10 or more | | 10 or more |
| 20 or more | | 20 or more |
| 50 or more | | 50 or more |
| 100 or more | | 100 or more |
| 150 or more | | 150 or more |
| 200 or more | | 200 or more |
| 250 or more | | 250 or more |
| 300 or more | | 300 or more |
| 350 or more | | 350 or more |
| 400 or more | | 400 or more |
| 450 or more | | 450 or more |
| 500 or more | | 500 or more |
| 550 or more | | 550 or more |
| 600 or more | | 600 or more |
| 650 or more | | 650 or more |
| 700 or more | | 700 or more |
| 750 or more | | 750 or more |
| 800 or more | | 800 or more |
| 850 or more | | 850 or more |
| 900 or more | | 900 or more |
| 1000 or more | | 1000 or more |
| 1100 or more | | 1100 or more |
| 1200 or more | | 1200 or more |
| 1300 or more | | 1300 or more |
| 1400 or more | | 1400 or more |
| 1500 or more | | 1500 or more |
| 1600 or more | | 1600 or more |
| 1700 or more | | 1700 or more |
| 1800 or more | | 1800 or more |
| 1900 or more | | 1900 or more |
| 1200 or more | | 1200 or more |
| At least 50 but not long enough to include a repeated element. | | At least 50 but not long enough to include a repeated element. |
| At least 100 but not long enough to include a repeated element. | | At least 100 but not long enough to include a repeated element. |
| At least 150 but not long enough to include a repeated element. | | At least 150 but not long enough to include a repeated element. |
| 5 to 100 nucleotides | | 5 to 100 nucleotides |
| 10 to 150 nucleotides | | 10 to 150 nucleotides |
| 20 to 150 nucleotides | | 20 to 150 nucleotides |
| Template Construct No. 1 | | |
| Template Construct No. 2 | | |
| Template Construct No. 3 | | |

In an embodiment, a single or dual nickase eaCas9 is used to cleave the target DNA near the site of the mutation, or signature, to be modified, e.g., replaced. While not wishing to be bound by theory, in an embodiment, it is believed that the Cas9 mediated break induces HDR with the template nucleic acid to replace the target DNA sequence with the template sequence.

V.2 NHEJ Approaches for Gene Targeting

As described herein, nuclease-induced non-homologous end joining (NHEJ) can be used to target gene-specific knockouts. Nuclease-induced NHEJ can also be used to remove (e.g., delete) sequences in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs (e.g., motifs less than or equal to 50 nucleotides in length) as long as the generation of a specific final sequence is not required. If a double-strand break is targeted near to a target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. In this way, DNA segments as large as several hundred kilobases can be deleted. Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the the gene, e.g., a coding region, e.g., an early coding region of a gene, of interest can be used to knockout (i.e., eliminate expression of) a gene of interest. For example, early coding region of a gene of interest includes sequence immediately following a start codon, within a first exon of the coding sequence, or within 500 bp of the start codon (e.g., less than 500, 450, 400, 350, 300, 250, 200, 150, 100 or 50 bp).

Placement of Double Strand or Single Strand Breaks Relative to the Target Position In an embodiment, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-30 bp away from the target position (e.g., less than 30, 25, 20, 15, 10, 9, 8, 7, 6, 5, 4, 3, 2 or 1 bp from the target position).

In an embodiment, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In an embodiment, the gRNAs are configured to position cuts at the same position, or within a few nucleotides of one another, on different strands, essentially mimicking a double strand break. In an embodiment, the closer nick is between 0-30 bp away from the target position (e.g., less than 30, 25, 20, 15, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single strand breaks (i.e., two gRNAs complex with Cas9 nickases) on either side of the target position. In another embodiment, four gRNAs, e.g., independently, unimolecular (or chimeric) or modular gRNA, are configured to generate two pairs of single strand breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

V.3 Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

V.4 Other DNA Repair Pathways

SSBR (single strand break repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, Nature Reviews Genetics 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonculease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways hace a common feature in that they typically recognize a lesion on one strand of the DNA, then exo/endonucleaseases remove the lesion and leave a 1-30 nucleotide gap that is sub-sequentially filled in by DNA polymerase and finally sealed with ligase. A more complete picture is given in Li, Cell Research (2008) 18:85-98, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutL α which possesses an ATPase activity and is important for multiple steps of MMR. It possesses a PCNA/replication factor C (RFC)-dependent endonuclease activity which plays an important role in 3' nick-directed MMR involving EXO1. (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Pol that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al., Nature Reviews Molecular Cell Biology 15, 465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA polζ and Rev1.

Error-free postreplication repair (PRR) is another pathway for repairing a single stranded break left after a defective replication event.

V.5 Examples of gRNAs in Genome Editing Methods gRNAs as described herein can be used with a Cas9 molecule that cleaves both or a single strand and a template nucleic acid to alter the sequence of a target nucleic acid, e.g., at a target position or a target genetic signature. gRNAs useful in these method are described below.

In an embodiment, the gRNA, e.g., a chimeric gRNA, is configured such that it comprises one or more of the following properties;

a) it can position, e.g., when targeting a Cas9 molecule that makes double strand breaks, a double strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c) the tail domain is (i) at least 10, 15, 20, 25, 30, 35 or 40 nucleotides in length or (ii) the tail domain comprises 15, 20, 25, 30, 35, 40 nucleotides or all of the corresponding portions of a naturally occurring tail domain, e.g., a naturally occurring S. pyogenes or S. thermophilus tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(iii), and c(i).

In an embodiment, the gRNA is configured such that in comprises properties: a(i), b(iii), and c(ii).

In an embodiment, the gRNA, e.g., a chimeric gRNA, is configured such that it comprises one or more of the following properties;

a) it can position, e.g., when targeting a Cas9 molecule that makes single strand breaks, a single strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c) the tail domain is (i) at least 10, 15, 20, 25, 30, 35 or 40 nucleotides in length, or (ii) the tail domain comprises 15, 20, 25, 30, 35, 40 nucleotides or all of the corresponding portions of a naturally occurring tail domain, e.g., a naturally occurring S. pyogenes or S. thermophilus tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(iii), and c(i).

In an embodiment, the gRNA is configured such that in comprises properties: a(i), b(iii), and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment, a pair of gRNAs, e.g., a pair of chimeric gRNAs, comprising a first and a second gRNA, is configured such that they comprises one or more of the following properties;

a) one or both of the gRNAs can position, e.g., when targeting a Cas9 molecule that makes single strand breaks, a single strand break within (i) 50, 100, 150 or 200 nucleotides of a target position, or (ii) sufficiently close that the target position is within the region of end resection;

b) one or both have a targeting domain of at least 17 nucleotides, e.g., a targeting domain of (i) 17 or (ii) 18 nucleotides; and c) the tail domain of one or both is (i) at least 10, 15, 20, 25, 30, 35 or 40 nucleotides in length of (ii) comprises, 15, 20, 25, 30, 35, 40, or all of the corresponding portions of a naturally occurring tail domain, e.g., a naturally occurring *S. pyogenes, S. aureus* or *S. thermophilus* tail domain.

d) the gRNAs are configured such that, when hybridized to target nucleic acid, they are separated by 0-50, 0-100, 0-200, at least 10, at least 20, at least 30 or at least 50 nucleotides;

e) the breaks made by the first gRNA and second gRNA are on different strands; and f) the PAMs are facing outwards.

In an embodiment, one or both of the gRNAs is configured such that it comprises properties: a and b(i).

In an embodiment, one or both of the gRNAs is configured such that it comprises properties: a and b(ii).

In an embodiment, one or both of the gRNAs is configured such that it comprises properties: a and b(iii).

In an embodiment, one or both of the gRNAs configured such that it comprises properties: a and c.

In an embodiment, one or both of the gRNAs is configured such that in comprises properties: a, b, and c.

In an embodiment, one or both of the gRNAs is configured such that in comprises properties: a(i), b(i), and c(i).

In an embodiment, one or both of the gRNAs is configured such that in comprises properties: a(i), b(i), and c(ii).

In an embodiment, one or both of the gRNAs is configured such that in comprises properties: a(i), b(i), c, and d.

In an embodiment, one or both of the gRNAs is configured such that in comprises properties: a(i), b(i), c, and e.

In an embodiment, one or both of the gRNAs is configured such that in comprises properties: a(i), b(i), c, d, and e.

In an embodiment, one or both of the gRNAs is configured such that in comprises properties: a(i), b(iii), and c(i).

In an embodiment, one or both of the gRNAs is configured such that in comprises properties: a(i), b(iii), and c(ii).

In an embodiment, one or both of the gRNAs is configured such that in comprises properties: a(i), b(iii), c, and d.

In an embodiment, one or both of the gRNAs is configured such that in comprises properties: a(i), b(iii), c, and e.

In an embodiment, one or both of the gRNAs is configured such that in comprises properties: a(i), b(iii), c, d, and e.

In an embodiment, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNAs are used with a Cas9 nickase molecule having RuvC activity, e.g., a Cas9 molecule having the HNH activity inactivated, e.g., a Cas9 molecule having a mutation at H840, e.g., a H840A.

In an embodiment, the gRNAs are used with a Cas9 nickase molecule having RuvC activity, e.g., a Cas9 molecule having the HNH activity inactivated, e.g., a Cas9 molecule having a mutation at H863, e.g., a H863A.

VI. Target Cells

Cas9 molecules and gRNA molecules, e.g., a Cas9 molecule/gRNA molecule complex, can be used to manipulate a cell, e.g., to edit a target nucleic acid, in a wide variety of cells.

In some embodiments, a cell is manipulated by editing (e.g., correcting) one or more target genes, e.g., as described herein. In some embodiments, the expression of one or more target genes (e.g., one or more target genes described herein) is modulated, e.g., in vivo.

In an embodiment, the target cell is a retinal cell, e.g., a cell of the retinal pigment epithelium or a photoreceptor cell. In an embodiment, the target cell is a cone photoreceptor cell or cone cell, a rod photoreceptor cell or rod cell, or a macular cone photoreceptor cell. Cone photoreceptor cells in the macula are the first to demonstrate cell death in Usher Syndrome and in cone-rod dystrophies in general (this is the opposite of rod-cone dystrophies). In an exemplary embodiment, cone photoreceptors in the macular are targeted, i.e., cone photoreceptors in the macular are the target cells. In an embodiment, the target cell is a cochlear cell, e.g. an inner hair cell or an outer hair cell.

In an embodiment, the target cell is removed from the subject, the mutation corrected ex vivo, and the cell returned to the subject. In an embodiment, a photoreceptor cell is removed from the subject, the mutation corrected ex vivo, and the photoreceptor cell returned to the subject. In an embodiment, a cone photoreceptor cell is removed from the subject, the mutation corrected ex vivo, and the cone photoreceptor cell returned to the subject. In an embodiment, an inner or outer hair cell is removed from the subject, the mutation corrected ex vivo, and the inner or outer hair cell returned to the subject.

In an embodiment, the cells are induced pluripotent stem cells (iPS) cells or cells derived from iPS cells, e.g., iPS cells from the subject, modified to alter the gene and differentiated into retinal progenitor cells or retinal cells, e.g., retinal photoreceptors, and injected into the eye of the subject, e.g., subretinally, e.g., in the submacular region of the retina.

In an embodiment, the cells are induced pluripotent stem cells (iPS) cells or cells derived from iPS cells, e.g., iPS cells from the subject, modified to alter the gene and differentiated into cochlear cells, e.g., inner or outer hair cells, and injected into the cochlea of the subject.

In an embodiment, the cells are targeted in vivo, e.g., by delivery of the components, e.g., a Cas9 molecule and gRNA molecules, or a Cas9 molecule, gRNA molecules and donor template, to the target cells. In an embodiment, the target cells are retinal pigment epithelium or photoreceptor cells. In an embodiment, the target cells are inner or outer hair cells of the cochlea. In an embodiment, AAV is used to transduce the target cells.

VII. Delivery, Formulations and Routes of Administration

The components, e.g., a Cas9 molecule, gRNA molecule or template construct molecule, or all three, can be delivered, formulated, or administered in a variety of forms, see, e.g., Tables 14 and 15. When a Cas9 or gRNA component is delivered encoded in DNA the DNA will typically include a control region, e.g., comprising a promoter, to effect expression. Useful promoters for Cas9 molecule sequences include CMV, EF-1a, MSCV, PGK, CAG control promoters. Useful promoters for gRNAs include H1, EF-1a and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment, a promoter for a Cas9 molecule or a gRNA molecule can be, independently, inducible, tissue specific, or cell specific.

Table 14 provides examples of how the components can be formulated, delivered, or administered.

TABLE 14

| Elements | | | |
|---|---|---|---|
| Cas9 Molecule(s) | gRNA Molecule(s) | Donor Template Nucleic Acid | Comments |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided as a separate DNA molecule. |
| DNA | DNA | | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the gRNA. |
| DNA | | DNA | In this embodiment, a Cas9 molecule, typically an eaCas9 molecule, and a gRNA are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the Cas9. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided as a separate DNA molecule. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided on the same DNA molecule that encodes the Cas9. |
| mRNA | RNA | DNA | In this embodiment, a Cas9 molecule, typically an eaCas9 molecule, is translated from in vitro transcribed mRNA, and a gRNA is provided as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed mRNA, and a gRNA is transcribed from DNA. In this embodiment, the donor template is provided as a separate DNA molecule. |
| mRNA | DNA | | In this embodiment, a Cas9 molecule, typically an eaCas9 molecule, is translated from in vitro transcribed mRNA, and a gRNA is transcribed from DNA. In this embodiment, the donor template is provided on the same DNA molecule that encodes the gRNA. |
| Protein | DNA | DNA | In this embodiment, a Cas9 molecule, typically an eaCas9 molecule, is provided as a protein, and a gRNA is transcribed from DNA. In this embodiment, the donor template is provided as a separate DNA molecule. |
| Protein | DNA | | In this embodiment, a Cas9 molecule, typically an eaCas9 molecule, is provided as a protein, and a gRNA is transcribed from DNA. In this embodiment, the donor template is provided on the same DNA molecule that encodes the gRNA. |
| Protein | RNA | DNA | In this embodiment, an eaCas9 molecule is provided as a protein, and a gRNA is provided as transcribed or synthesized RNA. In this |

TABLE 14-continued

| Cas9 Molecule(s) | gRNA Molecule(s) | Donor Template Nucleic Acid | Comments |
|---|---|---|---|
| DNA | DNA | DNA | embodiment, the donor template is provided as a DNA molecule. In this embodiment, a Cas9 molecule, typically an eaCas9 molecule, and a gRNA are transcribed from DNA. In this embodiment, they are encoded on separate molecules. In this embodiment, the donor template is provided as a separate DNA molecule. |
| DNA | DNA | | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the gRNA. |
| | DNA | DNA | In this embodiment, a Cas9 molecule, typically an eaCas9 molecule, and a gRNA are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the Cas9. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided as a separate DNA molecule. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided on the same DNA molecule that encodes the Cas9. |
| mRNA | RNA | DNA | In this embodiment, a Cas9 molecule, typically an eaCas9 molecule, is translated from in vitro transcribed mRNA, and a gRNA is provided as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed mRNA, and a gRNA is transcribed from DNA. In this embodiment, the donor template is provided as a separate DNA molecule. |
| mRNA | DNA | | In this embodiment, a Cas9 molecule, typically an eaCas9 molecule, is translated from in vitro transcribed mRNA, and a gRNA is transcribed from DNA. In this embodiment, the donor template is provided on the same DNA molecule that encodes the gRNA. |
| Protein | DNA | DNA | In this embodiment, a Cas9 molecule, typically an eaCas9 molecule, is provided as a protein, and a gRNA is transcribed from DNA. In this embodiment, the donor template is provided as a separate DNA molecule. |
| Protein | DNA | | In this embodiment, a Cas9 molecule, typically an eaCas9 molecule, is provided as a protein, and a gRNA is transcribed from DNA. In this embodiment, the donor template is provided on the same DNA molecule that encodes the gRNA. |
| Protein | RNA | DNA | In this embodiment, an eaCas9 molecule is provided as a protein, and a gRNA is provided as transcribed or synthesized RNA. In this embodiment, the donor template is provided as a DNA molecule. |

Table 15 summarizes various delivery methods for the components of a Cas system, e.g., the Cas9 molecule component and the gRNA molecule component, as described herein.

TABLE 15

| Delivery Vector/Mode | | Delivery into Non-Dividing Cells | Duration of Expression | Genome Integration | Type of Molecule Delivered |
|---|---|---|---|---|---|
| Physical (eg, electroporation, particle gun, Calcium Phosphate transfection) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cas9 Molecule and or One or More gRNA Molecules

Nucleic acids encoding Cas9 molecules (e.g., eaCas9 molecules) and/or gRNA molecules, can be administered to subjects or delivered into cells by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

DNA encoding Cas9 molecules (e.g., eaCas9 molecules) and/or gRNA molecules can be conjugated to molecules (e.g., N-acetylgalactosamine) promoting uptake by the target cells (e.g., hepatocytes). Donor template molecules can be conjugated to molecules (e.g., N-acetylgalactosamine) promoting uptake by the target cells (e.g., hepatocytes).

In some embodiments, the Cas9- and/or gRNA-encoding DNA is delivered by a vector (e.g., viral vector/virus or plasmid).

Vectors can comprise a sequence that encodes a Cas9 molecule and/or a gRNA molecule.

A vectors can also comprise a sequence encoding a signal peptide (e.g., for nuclear localization, nucleolar localization, mitochondrial localization), fused, e.g., to a Cas9 molecule sequence. For example, the vectors can comprise a nuclear localization sequence (e.g., from SV40) fused to the sequence encoding the Cas9 molecule.

One or more regulatory/control elements, e.g., promoters, enhancers, introns, polyadenylation signals, Kozak consensus sequences, and internal ribosome entry sites (IRES), can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). In some embodiments, the virus infects dividing cells. In other embodiments, the virus infects non-dividing cells. Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

Exemplary viral vectors/viruses include, e.g., retroviruses, lentiviruses, adenovirus, adeno-associated virus (AAV), vaccinia viruses, poxviruses, and herpes simplex viruses.

In some embodiments, the Cas9- and/or gRNA-encoding DNA is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one or more coding regions for the genes necessary for additional rounds of virion replication and packaging replaced with other genes, or deleted.

In some embodiments, the Cas9- and/or gRNA-encoding DNA is delivered by a recombinant lentivirus. For example, the lentivirus is replication-defective, e.g., does not comprise one or more genes required for viral replication.

In some embodiments, the Cas9- and/or gRNA-encoding DNA is delivered by a recombinant adenovirus. In some embodiments, the adenovirus is engineered to have reduced immunity in human.

In some embodiments, the Cas9- and/or gRNA-encoding DNA is delivered by a recombinant AAV. In some embodiments, the AAV can incorporate its genome into that of the host cell. In some embodiments, the AAV is a self-complementary adeno-associated virus (scAAV), e.g., a scAAV that packages both strands which anneal together to form double stranded DNA.

In some embodiments, the Cas9- and/or gRNA-encoding DNA is delivered by a hybrid virus, e.g., a hybrid of one or more of the viruses described herein.

A Packaging cell is used to form a virus particle that is capable of infecting a target cell. Such a cell includes a 293 cell, which can package adenovirus, and a w2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, eg. Cas9. For example, an AAV vector used in gene therapy typically only possesses inverted terminal repeat (ITR) sequences from the AAV genome which are required for packaging and gene expression in the host or target cell. The missing viral functions are supplied in trans by the packaging cell line. Henceforth, the viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., geneticmodification of the viral envelope glycoproteins to incorporate targeting ligands such as a peptide ligand, a single chain antibodie, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutin (HA) can be incorporated to increase viral uptake into cells. In an embodiment, the viral vector has the ability of nuclear localization. For example, a virus that requires the breakdown of the cell wall (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In some embodiments, the Cas9- and/or gRNA-encoding DNA is delivered by a combination of a vector and a non-vector based method. For example, virosomes combine liposomes with an inactivated virus (e.g., HIV or influenza virus), which can result in more efficient gene transfer, e.g., in respiratory epithelial cells than either viral or liposomal methods alone.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 16.

TABLE 16

Lipids Used for Gene Transfer

| Lipid | Abbreviation | Feature |
| --- | --- | --- |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]- dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 17.

TABLE 17

Polymers Used for Gene Transfer

| Polymer | Abbreviation |
| --- | --- |
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars (e.g., N-acetyl-galactosamine (GalNAc)), and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovescicle (30-100 nm) of endocytic origin (e.g., can be produced from various cell types and can therefore be taken up by cells without the need of for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA Encoding a Cas9 Molecule

RNA encoding Cas9 molecules (e.g., eaCas9 molecules, eiCas9 molecules or eiCas9 fusion proteins) and/or gRNA molecules, can be delivered into cells by art-known methods or as described herein. For example, Cas9-encoding and/or gRNA-encoding RNA can be delivered, e.g., by microinjection, electroporation, lipid-mediated transfection, peptide-mediated delivery, or a combination thereof. Cas9-encoding and/or gRNA-encoding RNA can be conjugated to molecules (e.g., GalNAc) promoting uptake by the target cells (e.g., target cells described herein).

Delivery Cas9 Molecule Protein

Cas9 molecules (e.g., eaCas9 molecules, eiCas9 molecules or eiCas9 fusion proteins) can be delivered into cells by art-known methods or as described herein. For example, Cas9 protein molecules can be delivered, e.g., by microinjection, electroporation, lipid-mediated transfection, peptide-mediated delivery, or a combination thereof. Delivery can be accompanied by DNA encoding a gRNA or by a gRNA. Delivery can be accompanied by a donor template. Cas9 protein can be conjugated to molecules (e.g., GalNAc) promoting uptake by the target cells (e.g., target cells described herein).

Route of Administration

Systemic modes of administration include oral and parenteral routes. Parenteral routes include, by way of example, intravenous, intrarterial, intramuscular, intradermal, subcutaneous, intranasal, and intraperitoneal routes. Components administered systemically may be modified or formulated to target the components to the eye or inner ear.

Local modes of administration include, by way of example, intraocular, intraorbital, subconjuctival, intravitreal, subretinal, transscleral or introcochlear routes. In an embodiment, significantly smaller amounts of the components (compared with systemic approaches) may exert an effect when administered locally (for example, intravitreally) compared to when administered systemically (for example, intravenously). Local modes of administration can reduce or eliminate the incidence of potentially toxic side effects that may occur when therapeutically effective amounts of a component are administered systemically.

In an embodiment, components described herein are delivered subretinally, e.g., by subretinal injection. Subretinal injections may be made directly into the macular, e.g., submacular injection.

In an embodiment, components described herein are delivered by intravitreal injection. Intravitreal injection has a relatively low risk of retinal detachment. In an embodiment, nanoparticle or viral, e.g., AAV vector, is delivered intravitreally.

In an embodiment, components described herein are delivered into the inner ear, e.g., by intracochlear injection. Intracochlear injections may be made in the vicinity of inner and/or outer hair cells.

Methods for administration of agents to the eye and inner ear are known in the medical arts and can be used to administer components described herein. Exemplary methods include intraocular injection (e.g., retrobulbar, subretinal, submacular, intravitreal and intrachoridal), iontophoresis, eye drops, intraocular implantation (e.g., intravitreal, sub-Tenons and sub-conjunctival) and intracochlear injection.

Administration may be provided as a periodic bolus (for example, subretinally, intravenously, intravitreally or by intracochlear injection) or as continuous infusion from an internal reservoir (for example, from an implant disposed at an intra- or extra-ocular location (see, U.S. Pat. Nos. 5,443, 505 and 5,766,242)) or from an external reservoir (for example, from an intravenous bag). Components may be administered locally, for example, by continuous release from a sustained release drug delivery device immobilized to an inner wall of the eye or via targeted transscleral controlled release into the choroid (see, for example, PCT/US00/00207, PCT/US02/14279, Ambati et al. (2000)

INVEST. OPHTHALMOL. VIS. SCI. 41:1181-1185, and Ambati et al. (2000) INVEST. OPHTHALMOL. VIS. SCI. 41:1186-1191). A variety of devices suitable for administering components locally to the inside of the eye are known in the art. See, for example, U.S. Pat. Nos. 6,251,090, 6,299,895, 6,416,777, 6,413,540, and PCT/US00/28187.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly (caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly (ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly (vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for intraocular injection. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, template nucleic acid, or payload. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmacokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. E.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

Ex Vivo Delivery

In some embodiments, components described in Table 14 are introduced into cells which are then introduced into the subject. Methods of introducing the components can include, e.g., any of the delivery methods described in Table 15.

VIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O).CH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), (OCH$_2$CH$_2$OCH$_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., NH$_2$; alkylamino, dialkylamino, heterocyclyl, arylamino, diarylamino, heteroarylamino, diheteroarylamino, or amino acid); NH(CH$_2$CH$_2$NH)$_n$CH$_2$CH$_2$-amino (wherein amino can be, e.g., as described herein), —NHC(O)R (wherein R can be, e.g., alkyl, cycloalkyl, aryl, aralkyl, heteroaryl or sugar); cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s2U), 5-propynyl-uridine, 1-propynyl-pseudouridine, 5-taurinomethyl-uridine (τcm$^5$U), 1-taurinomethyl-pseudouridine, 5-taurinomethyl-2-thio-uridine(τm$^5$s2U), 1-taurinomethyl-4-thio-pseudouridine, 5-methyl-uridine (m$^5$U, i.e., having the nucleobase deoxythymine), 1-methyl-pseudouridine (m$^1$ψ), 5-methyl-2-thio-uridine (m$^5$s2U), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp$^3$U), 1-methyl-3-(3-amino-3-carboxypropyl) pseudouridine (acp$^3$ψ), 5-(isopentenylaminomethyl)uridine (inm$^5$U), 5-(isopentenylaminomethyl)-2-thio-uridine (inm$^5$s2U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s2Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl-2'-O-methyl-uridine (cmnm$^5$Um), 3,2'-O-dimethyl-uridine (m$^3$Um), 5-(isopentenylaminomethyl)-2'-O-methyl-uridine (inm$^5$Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)]uridine, pyrazolo[3,4-d]pyrimidines, xanthine, and hypoxanthine.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), α-thio-cytidine, 2'-O-methyl-cytidine (Cm), 5,2'-O-dimethyl-cytidine (m$^5$Cm), N4-acetyl-2'-O-methyl-cytidine (ac$^4$Cm), N4,2'-O-dimethyl-cytidine (m$^4$Cm), 5-formyl-2'-

O-methyl-cytidine (f $^5$Cm), N4,N4,2'-O-trimethyl-cytidine (m$^4_2$Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m$^1$A), 2-methyl-adenine (m$^2$A), N6-methyl-adenosine (m$^6$A), 2-methylthio-N6-methyl-adenosine (ms2 m$^6$A), N6-isopentenyl-adenosine (i$^6$A), 2-methylthio-N6-isopentenyl-adenosine (ms$^2$i$^6$A), N6-(cis-hydroxyisopentenyl)adenosine (io$^6$A), 2-methylthio-N6-(cis-hydroxyisopentenyl)adenosine (ms2io$^6$A), N6-glycinylcarbamoyl-adenosine (g$^6$A), N6-threonylcarbamoyl-adenosine (t$^6$A), N6-methyl-N6-threonylcarbamoyl-adenosine2-methylthio-N6-threonylcarbamoyl-(m$^6$t$^6$A), adenosine (ms$^2$g$^6$A), N6,N6-dimethyl-adenosine (m$^6_2$A), N6-hydroxynorvalylcarbamoyl-adenosine (hn$^6$A), 2-methylthio-N6-hydroxynorvalylcarbamoyl-adenosine (ms2hn$^6$A), N6-acetyl-adenosine (ac$^6$A), 7-methyl-adenine, 2-methylthio-adenine, 2-methoxy-adenine, α-thio-adenosine, 2'-O-methyl-adenosine (Am), N$^6$,2'-O-dimethyl-adenosine (m$^6$Am), N$^6$-Methyl-2'-deoxyadenosine, N6,N6,2'-O-trimethyl-adenosine (m$^6_2$Am), 1,2'-O-dimethyl-adenosine (m$^1$Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m$^1$I), wyosine (imG), methylwyosine (mimG), 4-demethyl-wyosine (imG-14), isowyosine (imG2), wybutosine (yW), peroxywybutosine (o2yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ$_0$), 7-aminomethyl-7-deaza-guanosine (preQ$_1$), archaeosine (G$^+$), 7-deaza-8-aza-guanosine, 6-thio-guanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m'G), N2-methyl-guanosine (m$^2$G), N2,N2-dimethyl-guanosine (m$^2$2G), N2,7-dimethyl-guanosine (m$^2$,7G), N2, N2,7-dimethyl-guanosine (m$^2$,2,7G), 8-oxo-guanosine, 7-methyl-8-oxo-guanosine, 1-meth thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m$^2$Gm), N2,N2-dimethyl-2'-O-methyl-guanosine (m$^2$2Gm), 1-methyl-2'-O-methyl-guanosine (m'Gm), N2,7-dimethyl-2'-O-methyl-guanosine (m$^2$,7Gm), 2'-O-methyl-inosine (Im), 1,2'-O-dimethyl-inosine (m'Im), O$^6$-phenyl-2'-deoxyinosine, 2'-O-ribosylguanosine (phosphate) (Gr(p)), 1-thio-guanosine, O$^6$-methyl-guanosine, O$^6$-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside as sown below:

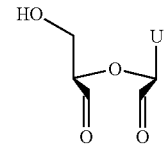

wherein "U" can be an unmodified or modified uridine.

In another embodiment, the 3' terminal U can be modified with a 2'3' cyclic phosphate as shown below:

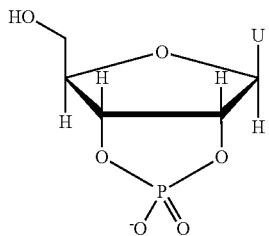

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, 0- and N-alkylated nucleotides, e.g., N6-methyl andenosine, can be incorporated into the gRNA. In some embodiments, sugar-modified ribonucleotides can be incorporated, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In an embodiment, one or more or all of the nucleotides in single stranded RNA molecule, e.g., a gRNA molecule, are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of a mRNA, and down-regulate gene expression. While not wishing to be bound by theory it is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

EXAMPLES

The following Examples are merely illustrative are are not intended to limit the scope or content of the invention in any way.

Example 1: Evaluation of Candidate Guide RNAs

The suitability of candidate gRNAs can be evaluated as described in this example. Although described for a chimeric gRNA, the approach can also be used to evaluate modular gRNAs.

Cloning gRNAs into Vectors

For each gRNA, a pair of overlapping oligonucleotides is designed and obtained. Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters maybe used to drive in vivo transcription (e.g., H1 promoter) or for in vitro transcription (e.g., T7 promoter).

Initial gRNA Screen

Each gRNA to be tested is transfected, along with a plasmid expressing Cas9 and a small amount of a GFP-expressing plasmid into human cells. In preliminary experiments, these cells can be immortalized human cell lines such as 293T, K562 or U205. Alternatively, primary human cells may be used. In this case, cells may be relevant to the eventual therapeutic cell target (for example, photoreceptor cells). The use of primary cells similar to the potential therapeutic target cell population may provide important information on gene targeting rates in the context of endogenous chromatin and gene expression.

Transfection may be performed using lipid transfection (such as Lipofectamine or Fugene) or by electroporation. Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) which recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1\text{-fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, mini-prepped and sequenced with a single primer. For large sequencing numbers, Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2: Assessment of Gene Targeting by HDR

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection,) genomic DNA may be isolated from a bulk population of transfected cells and PCR may be used to amplify the target region. Following PCR, gene targeting efficiency can be determined by several methods.

Determination of gene targeting frequency involves measuring the percentage of alleles that have undergone homologous directed repair (HDR) with the exogenously provided donor template or endogenous genomic donor sequence and which therefore have incorporated the desired correction (e.g., the missing G nucleotide at position 2299). If the desired HDR event creates or destroys a restriction enzyme site, the frequency of gene targeting may be determined by a RFLP assay. If no restriction site is created or destroyed, sequencing may be used to determine gene targeting frequency. If a RFLP assay is used, sequencing may still be used to verify the desired HDR event and ensure that no other mutations are present. If an exogenously provided donor template is employed, at least one of the primers is placed in the endogenous gene sequence outside of the region included in the homology arms, which prevents amplification of donor template still present in the cells. Therefore, the length of the homology arms present in the donor template may affect the length of the PCR amplicon. PCR amplicons can either span the entire donor region (both primers placed outside the homology arms) or they can span only part of the donor region and a single junction between donor and endogenous DNA (one internal and one external primer). If the amplicons span less than the entire donor region, two different PCRs should be used to amplify and sequence both the 5' and the 3' junction.

If the PCR amplicon is short (less than 600 bp) it is possible to use next generation sequencing. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low gene targeting rates.

If the PCR amplicon is too long for next generation sequencing, Sanger sequencing can be performed. For Sanger sequencing, purified PCR amplicons will be cloned into a plasmid backbone (for example, TOPO cloned using the LifeTech Zero Blunt® TOPO® cloning kit), transformed, miniprepped and sequenced.

The same or similar assays described above can be used to measure the percentage of alleles that have undergone HDR with endogenous genomic donor sequence and which therefore have incorporated the desired correction.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (941 sequences)

SEQ ID NO: 1 - protein, 1344 aa, Streptococcus mutans
KKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1387 aa, Streptococcus thermophilus
TKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 4 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 5 - RNA, 96 nt, Artificial Sequence
  S. pyogenes-derived gRNA
  misc_feature (1)..(20): Targeting domain; each n is a, c, u, g, unknown, or other
nnnnnnnnnnnnnnnnnnnnguuuuagagcuagaaauagcaaguuaaaauaaggcuaguccguuaucaacuugaaaaaguggcaccgagucggugc

SEQ ID NO: 6 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 7 - protein, 1368 aa, Streptococcus pyogenes [sequence omitted]

SEQ ID NO: 8 - protein, 12 aa, Artificial Sequence
  N-terminal RuvC-like domain
  MISC_FEATURE (2)..(2): I, V, M, L, or T
  MISC_FEATURE (4)..(4): T, I, V, S, N, Y, E, or L
  MISC_FEATURE (5)..(5): N, S, G, A, D, T, R, M, or F
  MISC_FEATURE (6)..(6): S, Y, N, or F
  MISC_FEATURE (7)..(7): V, I, L, C, T, or F
  MISC_FEATURE (9)..(9): W, F, V, Y, S, or L
  MISC_FEATURE (10)..(10): A, S, C, V, or G
  MISC_FEATURE (11)..(11): V, I, L, A, M, or H
  MISC_FEATURE (12)..(12): Any amino acid or absent
DXGXXXXGXXXX

SEQ ID NO: 9 - protein, 12 aa, Artificial Sequence
  N-terminal RuvC-like domain
  MISC_FEATURE (2)..(2): I, V, M, L, or T
  MISC_FEATURE (4)..(4): T, I, V, S, N, Y, E, or L
  MISC_FEATURE (5)..(5): N, S, G, A, D, T, R, M, or F
  MISC_FEATURE (7)..(7): V, I, L, C, T, or F
  MISC_FEATURE (9)..(9): W, F, V, Y, S, or L
  MISC_FEATURE (10)..(10): A, S, C, V, or G
  MISC_FEATURE (11)..(11): V, I, L, A, M, or H
  MISC_FEATURE (12)..(12): Any amino acid or absent
DXGXXSXGXXXX

SEQ ID NO: 10 - protein, 12 aa, Artificial Sequence
  N-terminal RuvC-like domain
  misc_feature (4)..(4): T, I, V, S, N, Y, E, or L
  misc_feature (5)..(5): N, S, G, A, D, T, R, M, or F
  misc_feature (11)..(11): V, I, L, A, M, or H
  misc_feature (12)..(12): Any amino acid or absent
DIGXXSVGWAXX

SEQ ID NO: 11 - protein, 12 aa, Artificial Sequence
  N-terminal RuvC-like domain
  MISC_FEATURE (12)..(12): Non-polar alkyl AA or hydroxyl AA
DIGTNSVGWAVX

SEQ ID NO: 12 - protein, 8 aa, Artificial Sequence
  RuvC-like domain
  MISC_FEATURE (2)..(2): V or H
  MISC_FEATURE (3)..(3): I, L, or V
  MISC_FEATURE (5)..(5): M or T
IXXEXARE

SEQ ID NO: 13 - protein, 8 aa, Artificial Sequence
  RuvC-like domain
  MISC_FEATURE (3)..(3): I, L, or V
IVXEMARE

SEQ ID NO: 14 - protein, 8 aa, Artificial Sequence
  RuvC-like domain
  MISC_FEATURE (4)..(4): H or L
  MISC_FEATURE (7)..(7): R or V
  MISC_FEATURE (8)..(8): E or V
HHAXDAXX

SEQ ID NO: 15 - protein, 8 aa, Artificial Sequence
  RuvC-like domain
HHAHDAYL

SEQ ID NO: 16 - protein, 11 aa, Artificial Sequence
  Sequence flanking N-terminal RuvC-like domain
  misc_feature (2)..(2): K or P
  misc_feature (4)..(4): V, L, I, or F
  misc_feature (5)..(5): G, A, or S
  misc_feature (6)..(6): L, I, V, or F
  misc_feature (7)..(7): N-terminal RuvC-like domain
  misc_feature (10)..(10): D, E, N, or Q
KXYXXXZTDXY

SEQ ID NO: 17 - protein, 27 aa, Artificial Sequence
  HNH-like domain
  MISC_FEATURE (1)..(1): D, E, Q, or N
  MISC_FEATURE (2)..(2): L, I, R, Q, V, M, or K
  MISC_FEATURE (3)..(3): D or E
  MISC_FEATURE (5)..(5): I, V, T, A, or L
  MISC_FEATURE (6)..(6): V, Y, I, L, F, or W
  MISC_FEATURE (8)..(8): Q, H, R, K, Y, I, L, F, or W
  MISC_FEATURE (9)..(9): S, A, D, T, or K
  MISC_FEATURE (10)..(10): F, L, V, K, Y, M, I, R, A, E, D, or Q
  MISC_FEATURE (11)..(11): L, R, T, I, V, S, C, Y, K, F, or G
  MISC_FEATURE (12)..(12): K, Q, Y, T, F, L, W, M, A, E, G, or S
  MISC_FEATURE (13)..(13): D, S, N, R, L, or T
  MISC_FEATURE (14)..(14): D, N, or S
  MISC_FEATURE (15)..(15): S, A, T, G, or R
  MISC_FEATURE (16)..(16): I, L, F, S, R, Y, Q, W, D, K, or H
  MISC_FEATURE (17)..(17): D, S, I, N, E, A, H, F, L, Q, M, G, Y, or V
  MISC_FEATURE (19)..(19): K, L, R, M, T, or F
  MISC_FEATURE (20)..(20): V, L, I, A, or T
  MISC_FEATURE (21)..(21): L, I, V, or A
  MISC_FEATURE (22)..(22): T, V, C, E, S, or A
  MISC_FEATURE (23)..(23): R, F, T, W, E, L, N, C, K, V, S, Q, I, Y, H, or A
  MISC_FEATURE (24)..(24): S, P, R, K, N, A, H, Q, G, or L
  MISC_FEATURE (25)..(25): D, G, T, N, S, K, A, I, E, L, Q, R, or Y
  MISC_FEATURE (26)..(26): K, V, A, E, Y, I, C, L, S, T, G, K, M, D, or F
XXXHXXPXXXXXXXXXXNXXXXXXXXN

SEQ ID NO: 18 - protein, 27 aa, Artificial Sequence
  HNH-like domain
  MISC_FEATURE (1)..(1): D or E
  MISC_FEATURE (2)..(2): L, I, R, Q, V, M, or K
  MISC_FEATURE (3)..(3): D or E
  MISC_FEATURE (5)..(5): I, V, T, A, or L
  MISC_FEATURE (6)..(6): V, Y, I, L, F, or W
  MISC_FEATURE (8)..(8): Q, H, R, K, Y, I, L, F, or W
  MISC_FEATURE (10)..(10): F, L, V, K, Y, M, I, R, A, E, D, or Q
  MISC_FEATURE (11)..(11): L, R, T, I, V, S, C, Y, K, F, or G
  MISC_FEATURE (12)..(12): K, Q, Y, T, F, L, W, M, A, E, G, or S
  MISC_FEATURE (16)..(16): I, L, F, S, R, Y, Q, W, D, K, or H
  MISC_FEATURE (17)..(17): D, S, I, N, E, A, H, F, L, Q, M, G, Y, or V
  MISC_FEATURE (22)..(22): T, V, C, E, S, or A
  MISC_FEATURE (23)..(23): R, F, T, W, E, L, N, C, K, V, S, Q, I, Y, H, or A
  MISC_FEATURE (24)..(24): S, P, R, K, N, A, H, Q, G, or L
  MISC_FEATURE (25)..(25): D, G, T, N, S, K, A, I, E, L, Q, R, or Y
  MISC_FEATURE (26)..(26): K, V, A, E, Y, I, C, L, S, T, G, K, M, D, or F
XXXHXXPXSXXXDDSXXNKVLXXXXXN

SEQ ID NO: 19 - protein, 27 aa, Artificial Sequence
  HNH-like domain
  MISC_FEATURE (1)..(1): D or E
  MISC_FEATURE (3)..(3): D or E
  MISC_FEATURE (8)..(8): Q, H, R, K, Y, I, L, or W
  MISC_FEATURE (10)..(10): F, L, V, K, Y, M, I, R, A, E, D, or Q
  MISC_FEATURE (11)..(11): L, R, T, I, V, S, C, Y, K, F, or G
  MISC_FEATURE (12)..(12): K, Q, Y, T, F, L, W, M, A, E, G, or S
  MISC_FEATURE (16)..(16): I, L, F, S, R, Y, Q, W, D, K, or H
  MISC_FEATURE (17)..(17): D, S, I, N, E, A, H, F, L, Q, M, G, Y, or V
  MISC_FEATURE (23)..(23): R, F, T, W, E, L, N, C, K, V, S, Q, I, Y, H, or A
  MISC_FEATURE (24)..(24): S, P, R, K, N, A, H, Q, G, or L
  MISC_FEATURE (25)..(25): D, G, T, N, S, K, A, I, E, L, Q, R, or Y
  MISC_FEATURE (26)..(26): K, V, A, E, Y, I, C, L, S, T, G, K, M, D, or F
XVXHIVPXSXXXDDSXXNKVLTXXXXN

SEQ ID NO: 20 - protein, 27 aa, Artificial Sequence
  HNH-like domain
  MISC_FEATURE (2)..(2): I or V
  MISC_FEATURE (6)..(6): I or V
  MISC_FEATURE (9)..(9): A or S
  MISC_FEATURE (11)..(11): I or L
  MISC_FEATURE (12)..(12): K or T
  MISC_FEATURE (14)..(14): D or N
  MISC_FEATURE (19)..(19): R, K. or L
  MISC_FEATURE (22)..(22): T or V
  MISC_FEATURE (23)..(23): S or R
  MISC_FEATURE (25)..(25): K, D, or A
  MISC_FEATURE (26)..(26): E, K, G, or N
DXDHIXPQXFXXDXSIDNXVLXXSXXN

SEQ ID NO: 21 - protein, 34 aa, Artificial Sequence
  Portion of eaCas9
  MISC_FEATURE (8)..(8): K or R
  MISC_FEATURE (12)..(12): V or T
  MISC_FEATURE (13)..(13): G or D
  MISC_FEATURE (14)..(14): E, Q, or D
  MISC_FEATURE (15)..(15): E or D
  MISC_FEATURE (19)..(19): D, N, or H
  MISC_FEATURE (20)..(20): Y, R, or N
  MISC_FEATURE (23)..(23): Q, D, or N
  MISC_FEATURE (25)..(25): HNH-like domain
  MISC_FEATURE (28)..(28): G or E
  MISC_FEATURE (30)..(30): S or G
  MISC_FEATURE (32)..(32): D or N
LYYLQNGXDMYXXXXLDIXXLSXYZNRXKXDXVP

SEQ ID NO: 22 - DNA, 4107 bp, Artificial Sequence
  S. pyogenes codon-optimized Cas9
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 23 - skipped

SEQ ID NO: 24 - DNA, 3249 bp, Artificial Sequence
  N. meningitidis codon-optimized Cas9
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 25 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 26 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - RNA, 104 nt, Artificial Sequence
  gRNA
  misc_feature (1)..(20): Targeting domain; each n is a, c, u, g, unknown, or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 28 - RNA, 106 nt, Artificial Sequence
  gRNA
  misc_feature (1)..(20): Targeting domain; each n is a, c, u, g, unknown, or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 29 - RNA, 116 nt, Artificial Sequence
  gRNA
  misc_feature (1)..(20): Targeting domain; each n is a, c, u, g, unknown, or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 96 nt, Artificial Sequence
  gRNA
  misc_feature (1)..(20): Targeting domain; each n is a, c, u, g, unknown, or other
nnnnnnnnnnnnnnnnnnnnguauuagagcuagaaauagcaaguuaauauaaggcuaguccguuaucaacuugaaaaaguggcaccgagucggugc

SEQ ID NO: 31 - RNA, 96 nt, Artificial Sequence
  gRNA
  misc_feature (1)..(20): Targeting domain; each n is a, c, u, g, unknown, or other
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 116 nt, Artificial Sequence
  gRNA
  misc_feature (1)..(20): Targeting domain; each n is a, c, u, g, unknown, or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 33 - RNA, 47 nt, Artificial Sequence
  S. pyogenes-derived gRNA proximal and tail domains
aaggcuaguccguuaucaacuugaaaaaguggcaccgagucggugcu

SEQ ID NO: 34 - RNA, 49 nt, Artificial Sequence
  gRNA proximal and tail domains
aaggcuaguccguuaucaacuugaaaaaguggcaccgagucgguggugc

SEQ ID NO: 35 - RNA, 51 nt, Artificial Sequence
  gRNA proximal and tail domains
aaggcuaguccguuaucaacuugaaaaaguggcaccgagucggugcggauc

SEQ ID NO: 36 - RNA, 31 nt, Artificial Sequence
  gRNA proximal and tail domains
aaggcuaguccguuaucaacuugaaaaagug

SEQ ID NO: 37 - RNA, 18 nt, Artificial Sequence
  gRNA proximal and tail domains
aaggcuaguccguuauca

SEQ ID NO: 38 - RNA, 12 nt, Artificial Sequence
  gRNA proximal and tail domains
aaggcuaguccg

SEQ ID NO: 39 - DNA, 3159 bp, Artificial Sequence
  S. aureus codon-optimized Cas9
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 40 - DNA, 20 bp, Artificial Sequence
  USH2A-179 gRNA targeting domain (DNA)
gttagatgtcaccaattgta

SEQ ID NO: 41 - DNA, 43 bp, Artificial Sequence
  Donor construct containing USH2A-179 DNA sequence
  misc_feature (11)..(30): USH2A-179 targeting domain (DNA)
acttttatgggttagatgtcaccaattgtaaggcctgtgactg

SEQ ID NO: 42 - RNA, 42 nt, Artificial Sequence
  S. pyogenes-derived modular gRNA component
  misc_feature (1)..(20): Targeting domain; each n is a, c, u, g, unknown, or other
  misc_feature (21)..(42): First complementarity domain
nnnnnnnnnnnnnnnnnnnnguuuuagagcuaugcuguuuug

SEQ ID NO: 43 - RNA, 85 nt, Artificial Sequence
  S. pyogenes-derived modular gRNA component
  misc_feature (1)..(9): 5' extension domain
  misc_feature (10)..(33): Second complementarity domain
  misc_feature (34)..(45): Proximal domain
  misc_feature (46)..(85): Tail domain
ggaaccauucaaaacagcauagcaaguuaaaauaaggcuaguccguuaucaacuugaaaaaguggcaccgagucggugcuuuuuu

SEQ ID NO: 44 - RNA, 62 nt, Artificial Sequence
  S. pyogenes-derived unimolecular gRNA component
  misc_feature (1)..(20): Targeting domain; each n is a, c, u, g, unknown, or other
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguuuuagagcuagaaauagcaaguuaaaauaaggcuaguccg

SEQ ID NO: 45 - RNA, 102 nt, Artificial Sequence
  S. pyogenes-derived unimolecular gRNA component
  misc_feature (1)..(20): Targeting domain; each n is a, c, u, g, unknown, or other
  misc_feature (21)..(32): First complementarity domain
  misc_feature (33)..(36): Linking domain
  misc_feature (37)..(50): Second complementarity domain
  misc_feature (51)..(62): Proximal domain
  misc_feature (63)..(82): Tail domain
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 46 - RNA, 75 nt, Artificial Sequence
  S. pyogenes-derived unimolecular gRNA component
  misc_feature (1)..(20): Targeting domain; each n is a, c, u, g, unknown, or other
  misc_feature (21)..(32): First complementarity domain
  misc_feature (37)..(40): Linking domain
  misc_feature (45)..(58): Second complementarity domain
  misc_feature (59)..(70): Proximal domain
  misc_feature (71)..(75): Tail domain
nnnnnnnnnnnnnnnnnnnnguuuuagagcuaugcugaaaagcauagcaaguuaaaauaaggcuaguccguuauc

SEQ ID NO: 47 - RNA, 87 nt, Artificial Sequence
  S. pyogenes-derived unimolecular gRNA component
  misc_feature (1)..(20): Targeting domain; each n is a, c, u, g, unknown, or other
  misc_feature (21)..(32): First complementarity domain
  misc_feature (43)..(46): Linking domain
  misc_feature (57)..(70): Second complementarity domain
  misc_feature (71)..(82): Proximal domain
  misc_feature (83)..(87): Tail domain
nnnnnnnnnnnnnnnnnnnnguuuuagagcuaugcuguuuuggaaacaaaacagcauagcaaguuaaaauaaggcuaguccguuauc

SEQ ID NO: 48 - RNA, 42 nt, Artificial sequence
  S. thermophilus-derived modular gRNA component
  misc_feature (1)..(20): Targeting domain; each n is a, c, u, g, unknown, or other
  misc_feature (21)..(42): First complementarity domain
nnnnnnnnnnnnnnnnnnnnguuuuagagcuguguuguuucg

SEQ ID NO: 49 - RNA, 78 nt, Artificial se
  S. thermophilus-derived modular gRNA component
  misc_feature (1)..(3): 5' extension domain
  misc_feature (4)..(27): Second complementarity domain
  misc_feature (28)..(40): Proximal domain
  misc_feature (41)..(78): Tail domain
gggcgaaacaacacagcgaguuaaaauaaggcuuaguccguacucaacuugaaaagguggcaccgauucgguguuuuu

SEQ ID NO: 50-51 - skipped (2 entries)

SEQ ID NO: 52 - RNA, 85 nt, Artificial Sequence
  S. pyogenes-derived modular gRNA component
gaaccauucaaaacagcauagcaaguuaaaauaaggcuaguccguuaucaacuugaaaaaguggcaccgagucggugcuuuuuuu

SEQ ID NO: 53 - skipped

SEQ ID NO: 54 - protein, 12 aa, Streptococcus thermophilus
DIGTNSVGWAVT

SEQ ID NO: 55 - skipped

SEQ ID NO: 56 - protein, 12 aa, Artificial Sequence
  N terminal RuvC-like domain
DVGTNSVGWAVT

SEQ ID NO: 57 - skipped

SEQ ID NO: 58 - protein, 12 aa, Butyrivibrio hungatei
DMGTNSVGWAVT

SEQ ID NO: 59 - protein, 12 aa, Solobacterium moorei F0204
DVGTSSVGWAVT

SEQ ID NO: 60 - protein, 12 aa, Peptoniphilus duerdenii
DIGTASVGWAVT

SEQ ID NO: 61 - protein, 12 aa, Treponema denticola
DVGTGSVGWAVT

SEQ ID NO: 62 - protein, 12 aa, Streptococcus mutans
DIGTNSVGWAVV

SEQ ID NO: 63 - protein, 12 aa, Streptococcus pyogenes
DIGTNSVGWAVI

SEQ ID NO: 64 - protein, 12 aa, Listeria innocua
DIGTNSVGWAVL

SEQ ID NO: 65 - protein, 12 aa, Flavobacterium branchiophilum FL-15
DLGTNSIGWAVV

SEQ ID NO: 66 - protein, 11 aa, Pedobacter glucosidilyticus
DLGTNSIGWAI

SEQ ID NO: 67 - protein, 12 aa, Bacteroides fragilis, NCTC 9343
DLGTNSIGWALV

SEQ ID NO: 68 - protein, 12 aa, Fusobacterium nucleatum
DIGTNSVGWCVT

SEQ ID NO: 69 - protein, 12 aa, Acidaminococcus sp. D21
DIGTNSVGYAVT

SEQ ID NO: 70 - protein, 12 aa, Coprococcus catus GD-7
DMGTGSLGWAVT

SEQ ID NO: 71 - protein, 12 aa, Oenococcus kitaharae DSM 17330
DIGTSSVGWAAI

SEQ ID NO: 72 - protein, 12 aa, Catenibacterium mitsuokai DSM 15897
DLGTGSVGWAVV

SEQ ID NO: 73 - protein, 12 aa, Mycoplasma gallisepticum str. F
DLGVGSVGWAIV

SEQ ID NO: 74 - protein, 12 aa, Mycoplasma ovipneumoniae SC01
DLGIASIGWAII

SEQ ID NO: 75 - protein, 12 aa, Mycoplasma canis PG 14
DLGIASVGWAIV

SEQ ID NO: 76 - protein, 12 aa, Mycoplasma synoviae 53
DLGVASVGWSIV

SEQ ID NO: 77 - protein, 12 aa, Eubacterium rectale
DIGIASVGWAIL

SEQ ID NO: 78 - protein, 12 aa, Enterococcus faecalis TX0012
DLGISSVGWSVI

SEQ ID NO: 79 - protein, 12 aa, Ilyobacter polytropus DSM 2926
DIGIASVGWSVI

SEQ ID NO: 80 - protein, 12 aa, Ruminococcus albus 8
DVGIGSIGWAVI

SEQ ID NO: 81 - protein, 12 aa, Elusimicrobium minutum Pei191
DLGVGSIGFAIV

SEQ ID NO: 82 - protein, 12 aa, Akkermansia muciniphila
DIGYASIGWAVI

SEQ ID NO: 83 - protein, 12 aa, Prevotella ruminicola
DTGTNSLGWAIV

SEQ ID NO: 84 - protein, 12 aa, Cand. Puniceispirillum marinum
DLGTNSIGWCLL

SEQ ID NO: 85 - protein, 12 aa, Rhodospirillum rubrum
DIGTDSLGWAVF

SEQ ID NO: 86 - protein, 12 aa, Lactobacillus rhamnosus
DIGSNSIGFAVV

SEQ ID NO: 87 - protein, 12 aa, Sphaerochaeta globus str. Buddy
DLGVGSIGVAVA

SEQ ID NO: 88 - protein, 12 aa, Rhodopseudomonas palustris
DLGIASCGWGVV

SEQ ID NO: 89 - protein, 12 aa, Mycoplasma mobile 163K
DLGIASVGWCLT

SEQ ID NO: 90 - protein, 12 aa, Streptococcus thermophilus LMD-9
DIGIGSVGVGIL

SEQ ID NO: 91 - protein, 12 aa, Staphylococcus lugdunensis M23590
DIGITSVGYGLI

SEQ ID NO: 92 - protein, 12 aa, Eubacterium dolichum DSM 3991
DIGITSVGFGII

SEQ ID NO: 93 - protein, 12 aa, Lactobacillus coryniformis KCTC 3535
DVGITSTGYAVL

SEQ ID NO: 94 - protein, 12 aa, Nitratifractor salsuginis DSM 16511
DLGITSFGYAIL

SEQ ID NO: 95 - protein, 12 aa, Bifidobacterium bifidum S17
DIGNASVGWSAF

SEQ ID NO: 96 - protein, 12 aa, Lactobacillus gasseri
DVGTNSCGWVAM

SEQ ID NO: 97 - protein, 12 aa, Acidothermus cellulolyticus 11B
DVGERSIGLAAV

SEQ ID NO: 98 - protein, 12 aa, Bifidobacterium longum DJO10A
DVGLNSVGLAAV

SEQ ID NO: 99 - protein, 12 aa, Bifidobacterium dentium
DVGLMSVGLAAI

SEQ ID NO: 100 - protein, 12 aa, Corynebacterium diphtheriae
DVGTFSVGLAAI

SEQ ID NO: 101 - protein, 12 aa, Staphylococcus pseudintermedius ED99
DIGTGSVGYACM

SEQ ID NO: 102 - protein, 12 aa, Capnocytophaga ochracea
DLGTTSIGFAHI

SEQ ID NO: 103 - protein, 12 aa, Prevotella denticola
DLGTNSIGSSVR

SEQ ID NO: 104-113 - skipped (10 entries)

SEQ ID NO: 114 - protein, 12 aa, Ralstonia solanacearum
DIGTNSIGWAVI

SEQ ID NO: 115-126 - skipped (12 entries)

SEQ ID NO: 127 - protein, 12 aa, Pasteurella multocida str. Pm70
DLGIASVGWAVV

SEQ ID NO: 128-129 - skipped (2 entries)

SEQ ID NO: 130 - protein, 12 aa, Comamonas granuli
DIGIASVGWAVL

SEQ ID NO: 131 - protein, 12 aa, Helicobacter mustelae 12198
DIGIASIGWAVI

SEQ ID NO: 132 - protein, 12 aa, Agathobacter rectalis
DIGIASVGWAII

SEQ ID NO: 133 - protein, 12 aa, Clostridium cellulolyticum H10
DVGIASVGWAVI

SEQ ID NO: 134 - protein, 11 aa, Methylophilus sp. OH31
DIGIASVGWAL

SEQ ID NO: 135 - protein, 12 aa, Neisseria meningitidis
DIGIASVGWAMV

SEQ ID NO: 136-137 - skipped (2 entries)

SEQ ID NO: 138 - protein, 12 aa, Clostridium perfringens
DIGITSVGWAVI

SEQ ID NO: 139 - skipped

SEQ ID NO: 140 - protein, 12 aa, Wolinella succinogenes DSM 1740
DLGISSLGWAIV

SEQ ID NO: 141-143 - skipped (3 entries)

SEQ ID NO: 144 - protein, 12 aa, Azospirillum sp. B510
DLGTNSIGWGLL

SEQ ID NO: 145-146 - skipped (2 entries)

SEQ ID NO: 147 - protein, 12 aa, Verminephrobacter eiseniae
DLGSTSLGWAIF

SEQ ID NO: 148 - protein, 12 aa, Campylobacter jejuni, NCTC 11168
DIGISSIGWAFS

SEQ ID NO: 149-151 - skipped (3 entries)

SEQ ID NO: 152 - protein, 12 aa, Parvibaculum lavamentivorans DS-1
DIGTTSIGFSVI

SEQ ID NO: 153-159 - skipped (7 entries)

SEQ ID NO: 160 - protein, 12 aa, Dinoroseobacter shibae DFL 12
DIGTSSIGWWLY

SEQ ID NO: 161 - protein, 12 aa, Nitrobacter hamburgensis X14
DLGSNSLGWFVT

SEQ ID NO: 162 - protein, 12 aa, Bradyrhizobium sp. BTAi1
DLGANSLGWFVV

SEQ ID NO: 163-170 - skipped (8 entries)

SEQ ID NO: 171 - protein, 15 aa, Bacillus cereus
DIGLRIGITSCGWSI

SEQ ID NO: 172 - protein, 12 aa, Sutterella wadsworthensis
DMGAKYTGVFYA

SEQ ID NO: 173 - protein, 12 aa, Wolinella succinogenes DSM 1740
DLGGKNTGFFSF

SEQ ID NO: 174 - protein, 12 aa, Francisella tularensis
DLGVKNTGVFSA

SEQ ID NO: 175 - protein, 12 aa, Gamma proteobacterium HTCC5015
DLGAKFTGVALY

SEQ ID NO: 176 - protein, 12 aa, Legionella pneumophila str. Paris
DLGGKFTGVCLS

SEQ ID NO: 177 - protein, 12 aa, Parasutterella excrementihominis
DLGGTYTGTFIT

SEQ ID NO: 178 - protein, 28 aa, Veillonella atypica ACS-134-V-Col7a
YDIDHIYPRSLTKDDSFDNLVLCERTAN

SEQ ID NO: 179 - protein, 28 aa, Fusobacterium nucleatum
DIDHIYPRSKVIKDDSFDNLVLVLKNEN

SEQ ID NO: 180 - protein, 27 aa, Filifactor alocis
DRDHIYPQSKIKDDSIDNLVLVNKTYN

SEQ ID NO: 181 - protein, 27 aa, Solobacterium moorei F0204
DIDHIYPRSKIKDDSITNRVLVEKDIN

SEQ ID NO: 182 - protein, 27 aa, Treponema denticola
DIDHIYPQSKIKDDSISNRVLVCSSCN

SEQ ID NO: 183 - protein, 27 aa, Coprococcus catus GD-7
DIDHIYPQSKTMDDSLNNRVLVKKNYN

SEQ ID NO: 184 - protein, 27 aa, Peptoniphilus duerdenii
DQDHIYPKSKIYDDSLENRVLVKKNLN

SEQ ID NO: 185 - protein, 27 aa, Catenibacterium mitsuokai DSM 15897
QIDHIVPQSLVKDDSFDNRVLVVPSEN

SEQ ID NO: 186 - protein, 27 aa, Streptococcus mutans
DIDHIIPQAFIKDNSIDNRVLTSSKEN

SEQ ID NO: 187 - protein, 27 aa, Streptococcus thermophilus
DIDHIIPQAFLKDNSIDNKVLVSSASN

SEQ ID NO: 188 - protein, 27 aa, Oenococcus kitaharae DSM 17330
DIDHIIPQAYTKDNSLDNRVLVSNITN

SEQ ID NO: 189 - protein, 27 aa, Listeria innocua
DIDHIVPQSFITDNSIDNLVLTSSAGN

SEQ ID NO: 190 - protein, 27 aa, Streptococcus pyogenes
DVDHIVPQSFLKDDSIDNKVLTRSDKN

SEQ ID NO: 191 - protein, 27 aa, Acidaminococcus sp. D21
NIDHIYPQSMVKDDSLDNKVLVQSEIN

SEQ ID NO: 192 - protein, 27 aa, Lactobacillus rhamnosus GG
DIDHILPQSLIKDDSLDNRVLVNATIN

SEQ ID NO: 193 - protein, 27 aa, Lactobacillus gasseri
DIDHILPQSFIKDDSLENRVLVKKAVN

SEQ ID NO: 194 - protein, 27 aa, Staphylococcus pseudintermedius ED99
EVDHIFPRSFIKDDSIDNKVLVIKKMN

SEQ ID NO: 195 - protein, 27 aa, Olsenella uli
EVDHIIPRSYIKDDSFENKVLVYREEN

SEQ ID NO: 196 - protein, 27 aa, Bifidobacterium bifidum S17
DIDHIIPQAVTQNDSIDNRVLVARAEN

SEQ ID NO: 197 - protein, 27 aa, Mycoplasma gallisepticum str. F
EIDHIIPYSISFDDSSSNKLLVLAESN

SEQ ID NO: 198 - protein, 27 aa, Mycoplasma canis PG 14
EIDHIIPYSLCFDDSSANKVLVHKQSN

SEQ ID NO: 199 - protein, 27 aa, Ilyobacter polytropus DSM 2926
DIDHIIPYSRSMDDSYSNKVLVLSGEN

SEQ ID NO: 200 - protein, 27 aa, Uncultured Termite group 1 bacterium
DIDHIIPYSKSMDDSFNNKVLCLAEEN

SEQ ID NO: 201 - protein, 27 aa, Campylobacter jejuni
EIDHIYPYSRSFDDSYMNKVLVFTKQN

SEQ ID NO: 202 - protein, 27 aa, Clostridium cellulolyticum H10
QIDHIYPYSRSMDDSYMNKVLVLTDEN

SEQ ID NO: 203 - protein, 27 aa, Clostridium perfringens
EIDHIIPFSRSFDDSLSNKILVLGSEN

SEQ ID NO: 204 - protein, 27 aa, Neisseria meningitidis
EIDHALPFSRTWDDSFNNKVLVLGSEN

SEQ ID NO: 205 - protein, 27 aa, Pasteurella multocida str. Pm70
EIDHALPFSRTWDDSFNNKVLVLASEN

SEQ ID NO: 206 - protein, 27 aa, Enterococcus faecalis TX0012
EIDHIIPISISLDDSINNKVLVLSKAN

SEQ ID NO: 207 - protein, 27 aa, Eubacterium dolichum DSM 3991
EVDHIIPISISLDDSITNKVLVTHREN

SEQ ID NO: 208 - protein, 27 aa, Acidovorax ebreus
QVDHALPYSRSYDDSKNNKVLVLTHEN

SEQ ID NO: 209 - protein, 27 aa, Streptococcus thermophilus LMD-9
EVDHILPLSITFDDSLANKVLVYATAN

SEQ ID NO: 210 - protein, 27 aa, Eubacterium rectale
EIDHIIPRSISFDDARSNKVLVYRSEN

SEQ ID NO: 211 - protein, 27 aa, Staphylococcus lugdunensis M23590
EVDHIIPRSVSFDNSYHNKVLVKQSEN

SEQ ID NO: 212 - protein, 27 aa, Roseburia intestinalis
DIDHILPYSITFDDSFRNKVLVTSQEN

SEQ ID NO: 213 - protein, 27 aa, Wolinella succinogenes DSM 1740
EIDHILPRSRSADDSFANKVLCLARAN

SEQ ID NO: 214 - protein, 27 aa, Cand. Puniceispirillum marinum
EIEHLLPFSLTLDDSMANKTVCFRQAN

SEQ ID NO: 215 - protein, 27 aa, Azospirillum sp. B510
DIDHILPFSVSLDDSAANKVVCLREAN

SEQ ID NO: 216 - protein, 27 aa, Bradyrhizobium sp. BTAi1
DIDHLIPFSISWDDSAANKVVCMRYAN

SEQ ID NO: 217 - protein, 27 aa, Nitrobacter hamburgensis X14
DIDHILPVAMTLDDSPANKIICMRYAN

SEQ ID NO: 218 - protein, 27 aa, Dinoroseobacter shibae
DVDHILPYSRTLDDSFPNRTLCLREAN

SEQ ID NO: 219 - protein, 27 aa, Verminephrobacter eiseniae
EIEHILPFSRTLDDSLNNRTVAMRRAN

SEQ ID NO: 220 - protein, 27 aa, Lactobacillus coryniformis KCTC 3535
EVDHIIPYSISWDDSYTNKVLTSAKCN

SEQ ID NO: 221 - protein, 27 aa, Rhodopseudomonas palustris
QVDHILPWSRFGDDSYLNKTLCTARSN

SEQ ID NO: 222 - protein, 27 aa, Ralstonia syzygii R24
QVDHILPFSKTLDDSFANKVLAQHDAN

SEQ ID NO: 223 - protein, 27 aa, Helicobacter mustelae 12198
QIDHAFPLSRSLDDSQSNKVLCLTSSN

SEQ ID NO: 224 - protein, 27 aa, Mycoplasma mobile 163K
DIDHIVPRSISFDDSFSNLVIVNKLDN

SEQ ID NO: 225 - protein, 27 aa, Mycoplasma ovipneumoniae SC01
EIEHIIPYSMSYDNSQANKILTEKAEN

SEQ ID NO: 226 - protein, 27 aa, Mycoplasma synoviae 53
EIDHVIPYSKSADDSWFNKLLVKKSTN

SEQ ID NO: 227 - protein, 27 aa, Aminomonas paucivorans DSM 12260
EMDHILPYSRSLDNGWHNRVLVHGKDN

SEQ ID NO: 228 - protein, 27 aa, Ruminococcus albus 8
EVDHIVPYSLILDNTINNKALVYAEEN

SEQ ID NO: 229 - protein, 27 aa, Fibrobacter succinogenes
EIEHVIPQSLYFDDSFSNKVICEAEVN

SEQ ID NO: 230 - protein, 27 aa, Bacteroides fragilis, NCTC 9343
DIEHIIPQARLFDDSFSNKTLEARSVN

SEQ ID NO: 231 - protein, 27 aa, Capnocytophaga sputigena
EIEHIVPKARVFDDSFSNKTLTFHRIN

SEQ ID NO: 232 - protein, 28 aa, Finegoldia magna
DKDHIIPQSMKKDDSIINNLVLVNKNAN

SEQ ID NO: 233 - protein, 27 aa, Parvibaculum lavamentivorans DS-1
EVEHIWPRSRSFDNSPRNKTLCRKDVN

SEQ ID NO: 234 - protein, 27 aa, Bacillus cereus
IVNHIIPYNRSFDDTYHNRVLTLTETK

SEQ ID NO: 235 - protein, 27 aa, Prevotella micans
DMEHTIPKSISFDNSDQNLTLCESYYN

SEQ ID NO: 236 - protein, 27 aa, Prevotella ruminicola
DIEHTIPRSAGGDSTKMNLTLCSSRFN

SEQ ID NO: 237 - protein, 27 aa, Flavobacterium columnare
DIEHTIPRSISQDNSQMNKTLCSLKFN

SEQ ID NO: 238 - protein, 27 aa, Rhodospirillum rubrum
DIDHVIPLARGGRDSLDNMVLCQSDAN

SEQ ID NO: 239 - protein, 27 aa, Elusimicrobium minutum Pei191
DIEHLFPIAESEDNGRNNLVISHSACN

SEQ ID NO: 240 - protein, 27 aa, Sphaerochaeta globus str. Buddy
DVDHIFPRDDTADNSYGNKVVAHRQCN

SEQ ID NO: 241 - protein, 27 aa, Nitratifractor salsuginis DSM 16511
DIEHIVPQSLGGLSTDYNTIVTLKSVN

SEQ ID NO: 242 - protein, 27 aa, Acidothermus cellulolyticus 11B
ELDHIVPRTDGGSNRHENLAITCGACN

SEQ ID NO: 243 - protein, 28 aa, Bifidobacterium longum DJO10A
EMDHIVPRKGVGSTNTRTNFAAVCAECN

SEQ ID NO: 244 - protein, 28 aa, Bifidobacterium dentium
EMDHIVPRKGVGSTNTRVNLAAACAACN

SEQ ID NO: 245 - protein, 28 aa, Corynebacterium diphtheria
EMDHIVPRAGQGSTNTRENLVAVCHRCN

SEQ ID NO: 246 - protein, 33 aa, Sutterella wadsworthensis
EIDHILPRSLIKDARGIVFNAEPNLIYASSRGN

SEQ ID NO: 247 - protein, 33 aa, Gamma proteobacterium HTCC5015
EIDHIIPRSLTGRTKKTVFNSEANLIYCSSKGN

SEQ ID NO: 248 - protein, 33 aa, Parasutterella excrementihominis
EIDHIIPRSLTLKKSESIYNSEVNLIFVSAQGN

SEQ ID NO: 249 - protein, 33 aa, Legionella pneumophila str. Paris
EIDHIYPRSLSKKHFGVIFNSEVNLIYCSSQGN

SEQ ID NO: 250 - protein, 33 aa, Wolinella succinogenes DSM 1740
EIDHILPRSHTLKIYGTVFNPEGNLIYVHQKCN

SEQ ID NO: 251 - protein, 30 aa, Francisella tularensis
ELDHIIPRSHKKYGTLNDEANLICVTRGDN

SEQ ID NO: 252 - protein, 27 aa, Akkermansia muciniphila
ELEHIVPHSFRQSNALSSLVLTWPGVN

SEQ ID NO: 253-302 - skipped (50 entries)

SEQ ID NO: 303 - DNA, 3333 bp, Neisseria meningitidis
atggtgcctaagaagaagagaaaggtggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttacccatacgatgttccagattacgctgcagctccagcagcgaagaaaaagaagctggattaa

SEQ ID NO: 304-305 - skipped (2 entries)

SEQ ID NO: 306 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 307 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 308 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 309 - protein, 1397 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 310 - protein, 1363 aa, Lactobacillus rhamnosus
  MISC_FEATURE (13)..(24): N-terminal RuvC (see SEQ ID NO:86)
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 311 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 312 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 313 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 314 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 315 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 316 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 317 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 318 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 319 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 320 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 321 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 322 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 323 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 324 - skipped

SEQ ID NO: 325 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 326 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 327 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 329 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 330 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 331 - protein, 1472 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 332 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 333 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 334 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 335 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 336 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 337 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 338 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 339 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 340 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 341 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 342 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 343 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 344 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 345 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 346 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 347 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 348 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 349 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 350 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 351 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 352 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 353 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 354 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 355 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 356 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 357 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 358 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 359 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 360 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 361 - skipped

SEQ ID NO: 362 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 363 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 364 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 365 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 366 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 367 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 368 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 369 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 370 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 371 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 372 - protein, 1061 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 373 - protein, 1011 aa, Uncultured delta proteobacterium HF0070 07E19
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 374 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 375 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 376 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 379 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 380 - protein, 1035 aa, Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 381 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 382 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 383 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 384 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 385 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 386 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 387 - DNA, 1150 bp, Artificial Sequence
  5' homology arm for 2299delG correction
aaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgt

SEQ ID NO: 388 - DNA, 1150 bp, Artificial Sequence
  3' homology arm for 2299delG correction
agtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatga

SEQ ID NO: 389 - DNA, 2301 bp, Artificial Sequence
  Template construct 1
  misc_feature (1)..(1150): 5' homology arm
  misc_feature (1151)..(1151): Inserted base to correct G deletion
  misc_feature (1152)..(2301): 3' homology arm
aaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatga

SEQ ID NO: 390 - DNA, 1703 bp, Artificial Sequence
  Template construct 2
  misc_feature (1)..(552): 5' homology arm
  misc_feature (553)..(553): Inserted base to correct G deletion
  misc_feature (554)..(1703): 3' homology arm
agcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatga

SEQ ID NO: 391 - DNA, 101 bp, Artificial Sequence
  ssODN
  misc_feature (1)..(50): 5' homology arm
  misc_feature (51)..(51): Inserted base to correct G deletion
  misc_feature (52)..(101): 3' homology arm
acctccatggctcagtgaacaaattctgcaatcctcactctgggcagtgtgagtgcaaaaaagaagccaaaggacttcagtgtgacacctgcagagaaaac

SEQ ID NO: 392 - RNA, 20 nt, Artificial Sequence
  USH2A-1 gRNA targeting domain
gagugcaaaaaagaagccaa

SEQ ID NO: 393 - RNA, 20 nt, Artificial Sequence
  USH2A-2/USH2A-179 gRNA targeting domain
guuagaugucaccaauugua

SEQ ID NO: 394 - RNA, 20 nt, Artificial Sequence
  USH2A-5/USH2A-188 gRNA targeting domain
ggugucacacugaaguccuu

SEQ ID NO: 395 - RNA, 20 nt, Artificial Sequence
  USH2A-6/USH2A-194 gRNA targeting domain
gccauggagguuacacuggc

SEQ ID NO: 396 - RNA, 17 nt, Artificial Sequence
  USH2A-10/USH2A-217 gRNA targeting domain
gucacaggccuuacaau

SEQ ID NO: 397 - RNA, 17 nt, Artificial Sequence
  USH2A-11/USH2A-221 gRNA targeting domain
gucacacugaaguccuu

SEQ ID NO: 398 - RNA, 17 nt, Artificial Sequence
  USH2A-15/USH2A-256 gRNA targeting domain
ugcaaaaaagaagccaa

SEQ ID NO: 399 - RNA, 17 nt, Artificial Sequence
  USH2A-16/USH2A-246 gRNA targeting domain
ugcagagaaaacuuuua

SEQ ID NO: 400 - RNA, 17 nt, Artificial Sequence
  USH2A-20/USH2A-239 gRNA targeting domain
uguucacugagccaugg

SEQ ID NO: 401 - RNA, 17 nt, Artificial Sequence
  USH2A-22/USH2A-219 gRNA targeting domain
auggagguuacacuggc

SEQ ID NO: 402 - RNA, 17 nt, Artificial Sequence
  USH2A-230 gRNA targeting domain
gcaagcccaauguugaa

SEQ ID NO: 403 - RNA, 17 nt, Artificial Sequence
  USH2A-9/USH2A-225 gRNA targeting domain
gcauuacagacaguccc

SEQ ID NO: 404-405 - skipped (2 entries)

SEQ ID NO: 406 - RNA, 17 nt, Artificial Sequence
  USH2A-8/USH2A-226 gRNA targeting domain
gucuguaaugcuaagac

SEQ ID NO: 407 - RNA, 20 nt, Artificial Sequence
  USH2A-4/USH2A-198/USH2A-417 gRNA targeting domain
gacacagcuggaucccuccc

SEQ ID NO: 408 - RNA, 20 nt, Artificial Sequence
  USH2A-204/USH2A-387 gRNA targeting domain
gagacagugcaauaaauguu

SEQ ID NO: 409 - RNA, 20 nt, Artificial Sequence
  USH2A-184 gRNA targeting domain
gcacuacacugcccagagug

SEQ ID NO: 410 - RNA, 20 nt, Artificial Sequence
  USH2A-197 gRNA targeting domain
gcacugucucccuucaacau

SEQ ID NO: 411 - skipped

SEQ ID NO: 412 - RNA, 20 nt, Artificial Sequence
  USH2A-3/USH2A-192 gRNA targeting domain
gccugugacugugacacagc

SEQ ID NO: 413-414 - skipped (2 entries)

SEQ ID NO: 415 - RNA, 19 nt, Artificial Sequence
  USH2A-292 gRNA targeting domain
gcacuacacugcccagagu

SEQ ID NO: 416 - RNA, 19 nt, Artificial Sequence
  USH2A-298 gRNA targeting domain
gccugugacugugacacag

SEQ ID NO: 417 - RNA, 20 nt, Artificial Sequence
  USH2A-297 gRNA targeting domain
ggccugugacugugacacag

SEQ ID NO: 418 - RNA, 18 nt, Artificial Sequence
  USH2A-284 gRNA targeting domain
ggugugaucauugcaauu

SEQ ID NO: 419 - RNA, 22 nt, Artificial Sequence
  USH2A-448 gRNA targeting domain
gacaccugcagagaaaacuuuu

SEQ ID NO: 420 - RNA, 21 nt, Artificial Sequence
  USH2A-445 gRNA targeting domain
gcauuacagacagucccaggg

SEQ ID NO: 421 - RNA, 23 nt, Artificial Sequence
  USH2A-427 gRNA targeting domain
gcuuaggugugaucauugcaauu

SEQ ID NO: 422 - RNA, 24 nt, Artificial Sequence
  USH2A-430 gRNA targeting domain
gcuucuuuuuugcacuacacugcc

SEQ ID NO: 423 - RNA, 24 nt, Artificial Sequence
  USH2A-426 gRNA targeting domain
ggcuuaggugugaucauugcaauu

SEQ ID NO: 424 - RNA, 24 nt, Artificial Sequence
  USH2A-438 gRNA targeting domain
guaaggccugugacugugacacag

SEQ ID NO: 425 - RNA, 24 nt, Artificial Sequence
  USH2A-446 gRNA targeting domain
gugacaccugcagagaaaacuuuu

SEQ ID NO: 426 - RNA, 17 nt, Artificial Sequence
  USH2A-264 gRNA targeting domain
gugucacacugaagucc

SEQ ID NO: 427 - RNA, 17 nt, Artificial Sequence
  USH2A-261 gRNA targeting domain
ggugugaucauugcaau

SEQ ID NO: 428 - RNA, 20 nt, Artificial Sequence
  USH2A-270 gRNA targeting domain
gggcucacauccaacaucau

SEQ ID NO: 429 - RNA, 102 nt, Artificial Sequence; identical to SEQ ID NO: 45
  S. pyogenes-derived gRNA w/ 6 U's that function as termination signal for U6 promoter
  misc_feature (1)..(20): n is a, c, g, or u

SEQ ID NO: 430 - RNA, 102 nt, Artificial Sequence
  gRNA w/ 6 U's that function as termination signal for U6 promoter
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 431-442 - skipped (12 entries)

SEQ ID NO: 443 - RNA, 17 nt, Artificial Sequence
  USH2A-249/USH2A-7 gRNA targeting domain
gcagagaaaacuuuuau

SEQ ID NO: 444-445 - skipped (2 entries)

SEQ ID NO: 446 - RNA, 17 nt, Artificial Sequence
  USH2A-12/USH2A-233 gRNA targeting domain
ugccaguguaaccucca

SEQ ID NO: 447 - RNA, 17 nt, Artificial Sequence
  USH2A-13/USH2A-236 gRNA targeting domain
uucugcaauccucacuc

SEQ ID NO: 448 - RNA, 17 nt, Artificial Sequence
  USH2A-14/USH2A-229 gRNA targeting domain
ucugcaauccucacucu

SEQ ID NO: 449 - RNA, 17 nt, Artificial Sequence
  USH2A-17/USH2A-241 gRNA targeting domain
auaaaaguuuucucugc

SEQ ID NO: 450 - RNA, 17 nt, Artificial Sequence
  USH2A-18 gRNA targeting domain
ucacacugcccagagug

SEQ ID NO: 451 - RNA, 17 nt, Artificial Sequence
  USH2A-19/USH2A-245 gRNA targeting domain
auuuguucacugagcca

SEQ ID NO: 452 - RNA, 17 nt, Artificial Sequence
  USH2A-21/USH2A-231 gRNA targeting domain
agccauggagguuacac

SEQ ID NO: 453 - RNA, 17 nt, Artificial Sequence
  USH2A-23/USH2A-235 gRNA targeting domain
cuacacugcccagagug

SEQ ID NO: 454 - RNA, 20 nt, Artificial Sequence
  USH2A-24/USH2A-178 gRNA targeting domain
aaauucugcaauccucacuc

SEQ ID NO: 455 - RNA, 20 nt, Artificial Sequence
  USH2A-25/USH2A-186 gRNA targeting domain
aauucugcaauccucacucu

SEQ ID NO: 456 - RNA, 20 nt, Artificial Sequence
  USH2A-26/USH2A-191 gRNA targeting domain
acacagcuggaucccucccu

SEQ ID NO: 457 - RNA, 20 nt, Artificial Sequence
  USH2A-27/USH2A-201 gRNA targeting domain
accugcagagaaaacuuuua

SEQ ID NO: 458 - RNA, 20 nt, Artificial Sequence
  USH2A-28/USH2A-196 gRNA targeting domain
acugucuguaaugcuaagac

SEQ ID NO: 459 - RNA, 20 nt, Artificial Sequence
  USH2A-29/USH2A-185 gRNA targeting domain
aggugugaucauugcaauuu

SEQ ID NO: 460 - RNA, 20 nt, Artificial Sequence
  USH2A-30/USH2A-193 gRNA targeting domain
auauuuuaucuuuagggcuu

SEQ ID NO: 461 - RNA, 20 nt, Artificial Sequence
  USH2A-31/USH2A-183 gRNA targeting domain
cccugccaguguaaccucca

SEQ ID NO: 462 - RNA, 20 nt, Artificial Sequence
  USH2A-32/USH2A-211 gRNA targeting domain
ccugcagagaaaacuuuuau

SEQ ID NO: 463 - RNA, 20 nt, Artificial Sequence
  USH2A-33/USH2A-174 gRNA targeting domain
cuccgaagcuuuaaugaugu

SEQ ID NO: 464 - RNA, 20 nt, Artificial Sequence
  USH2A-34/USH2A-181 gRNA targeting domain
cugucuguaaugcuaagaca

SEQ ID NO: 465 - RNA, 20 nt, Artificial Sequence
  USH2A-35/USH2A-175 gRNA targeting domain
acagucacaggccuuacaau

SEQ ID NO: 466 - RNA, 20 nt, Artificial Sequence
  USH2A-35/USH2A-199/USH2A-405 gRNA targeting domain
agaauuuguucacugagcca

SEQ ID NO: 467 - RNA, 20 nt, Artificial Sequence
  USH2A-37/USH2A-202/USH2A-399 gRNA targeting domain
auccaacaucauuaaagcuu

SEQ ID NO: 468 - RNA, 20 nt, Artificial Sequence
  USH2A-38/USH2A-205 gRNA targeting domain
auuacagacagucccaggga

SEQ ID NO: 469 - RNA, 20 nt, Artificial Sequence
  USH2A-39/USH2A-210 gRNA targeting domain
auuuguucacugagccaugg

SEQ ID NO: 470 - RNA, 20 nt, Artificial Sequence
  USH2A-40 targeting domain
cacucacacugcccagagug

SEQ ID NO: 471 - RNA, 20 nt, Artificial Sequence
  USH2A-41/USH2A-177/USH2A-279 gRNA targeting domain
cauuacagacagucccaggg

SEQ ID NO: 472 - RNA, 20 nt, Artificial Sequence
  USH2A-42/USH2A-180 gRNA targeting domain
ccauggagguuacacuggca

SEQ ID NO: 473 - RNA, 20 nt, Artificial Sequence
  USH2A-43/USH2A-182 gRNA targeting domain
cccauaaaaguuuucucugc

SEQ ID NO: 474 - RNA, 20 nt, Artificial Sequence
  USH2A-44/USH2A-189 gRNA targeting domain
cugagccauggagguuacac

SEQ ID NO: 475 - RNA, 20 nt, Artificial Sequence
  USH2A-45/USH2A-187/USH2A-363 gRNA targeting domain
uagcauuacagacaguccca

SEQ ID NO: 476 - RNA, 20 nt, Artificial Sequence
  USH2A-46/USH2A-215 gRNA targeting domain
uccagcugugucacagucac

SEQ ID NO: 477 - RNA, 20 nt, Artificial Sequence
  USH2A-47/USH2A-195/USH2A-321 gRNA targeting domain
uuagcauuacagacaguccc

SEQ ID NO: 478 - RNA, 17 nt, Artificial Sequence
  USH2A-48/USH2A-253 gRNA targeting domain
aauauauuuuaucuuua

SEQ ID NO: 479 - RNA, 17 nt, Artificial Sequence
  USH2A-49/USH2A-243 gRNA targeting domain
uuuuaucuuuagggcuu

SEQ ID NO: 480 - RNA, 17 nt, Artificial Sequence
  USH2A-50/USH2A-238 gRNA targeting domain
ugugaucauugcaauuu

SEQ ID NO: 481 - RNA, 17 nt, Artificial Sequence
  USH2A-51/USH2A-218 gRNA targeting domain
cgaagcuuuaaugaugu

SEQ ID NO: 482 - RNA, 17 nt, Artificial Sequence
  USH2A-52/USH2A-220 gRNA targeting domain
agaugucaccaauugua

SEQ ID NO: 483 - RNA, 17 nt, Artificial Sequence
  USH2A-53/USH2A-250 gRNA targeting domain
ugugacugugacacagc

SEQ ID NO: 484 - RNA, 17 nt, Artificial Sequence
  USH2A-54/USH2A-244 gRNA targeting domain
acagcuggaucccuccc

SEQ ID NO: 485 - RNA, 17 nt, Artificial Sequence
  USH2A-55/USH2A-228 gRNA targeting domain
cagcuggaucccucccu

SEQ ID NO: 486 - RNA, 17 nt, Artificial Sequence
  USH2A-56/USH2A-224 gRNA targeting domain
ucuguaaugcuaagaca

SEQ ID NO: 487 - RNA, 17 nt, Artificial Sequence
  USH2A-57/USH2A-222 gRNA targeting domain
cauuacagacaguccca

SEQ ID NO: 488 - RNA, 17 nt, Artificial Sequence
  USH2A-58/USH2A-232 gRNA targeting domain
uacagacagucccaggg

SEQ ID NO: 489 - RNA, 17 nt, Artificial Sequence
  USH2A-59/USH2A-251 gRNA targeting domain
acagacagucccaggga

SEQ ID NO: 490 - RNA, 17 nt, Artificial Sequence
  USH2A-60/USH2A-254 gRNA targeting domain
agcugugucacagucac

SEQ ID NO: 491 - RNA, 17 nt, Artificial Sequence
  USH2A-61/USH2A-227 gRNA targeting domain
uggagguuacacuggca

SEQ ID NO: 492 - RNA, 17 nt, Artificial Sequence
  USH2A-62/USH2A-242 gRNA targeting domain
caacaucauuaaagcuu

SEQ ID NO: 493-506 - skipped (14 entries)

SEQ ID NO: 507 - RNA, 17 nt, Artificial Sequence
  USH2A-507 gRNA targeting domain
acagugcaauaaauguu

SEQ ID NO: 508-511 - skipped (4 entries)

SEQ ID NO: 512 - RNA, 17 nt, Artificial Sequence
  USH2A-247 gRNA targeting domain
auuuaaaaggugaggau

SEQ ID NO: 513-518 - skipped (6 entries)

SEQ ID NO: 519 - RNA, 17 nt, Artificial Sequence
  USH2A-234 gRNA targeting domain
cugucucccuucaacau

SEQ ID NO: 520-522 - skipped (3 entries)

SEQ ID NO: 523 - RNA, 17 nt, Artificial Sequence
  USH2A-240 gRNA targeting domain
ugcaagcccaauguuga

SEQ ID NO: 524-526 - skipped (3 entries)

SEQ ID NO: 527 - RNA, 17 nt, Artificial Sequence
  USH2A-223 gRNA targeting domain
ugucucccuucaacauu

SEQ ID NO: 528-535 - skipped (8 entries)

SEQ ID NO: 536 - RNA, 20 nt, Artificial Sequence
  USH2A-223/USH2A-345 gRNA targeting domain
acagugcaauaaauguuugg

SEQ ID NO: 537-542 - skipped (6 entries)

SEQ ID NO: 543 - RNA, 20 nt, Artificial Sequence
  USH2A-176/USH2A-366 gRNA targeting domain
aucugcaagcccaauguuga

SEQ ID NO: 544 - skipped

SEQ ID NO: 545 - RNA, 20 nt, Artificial Sequence
  USH2A-200 gRNA targeting domain
cacugucucccuucaacauu

SEQ ID NO: 546 - RNA, 20 nt, Artificial Sequence
  USH2A-203/USH2A-384 gRNA targeting domain
cagugcaauaaauguuugga

SEQ ID NO: 547-554 - skipped (8 entries)

SEQ ID NO: 555 - RNA, 20 nt, Artificial Sequence
  USH2A-190/USH2A-318 gRNA targeting domain
ucugcaagcccaauguugaa

SEQ ID NO: 556 - skipped

SEQ ID NO: 557 - RNA, 17 nt, Artificial Sequence
  USH2A-259 gRNA targeting domain
gauaaaauauauuuaaa

SEQ ID NO: 558 - skipped

SEQ ID NO: 559 - RNA, 17 nt, Artificial Sequence
  USH2A-257 gRNA targeting domain
gugcaauaaauguuugg

SEQ ID NO: 560 - RNA, 17 nt, Artificial Sequence
  USH2A-258 gRNA targeting domain
aaauauauuuuaucuuu

SEQ ID NO: 561 - RNA, 17 nt, Artificial Sequence
  USH2A-257 gRNA targeting domain
aauauauuuaaaaggug

SEQ ID NO: 562-564 - skipped (3 entries)

SEQ ID NO: 565 - RNA, 17 nt, Artificial Sequence
  USH2A-252 gRNA targeting domain
uauuuaaaaggugagga

SEQ ID NO: 566 - skipped

SEQ ID NO: 567 - RNA, 17 nt, Artificial Sequence
  USH2A-248 gRNA targeting domain
ugcaauaaauguuugga

SEQ ID NO: 568 - skipped

SEQ ID NO: 569 - RNA, 20 nt, Artificial Sequence
  USH2A-216 gRNA targeting domain
aaagauaaaauauauuuaaa

SEQ ID NO: 570 - RNA, 20 nt, Artificial Sequence
  USH2A-208/USH2A-303 gRNA targeting domain
auauauuuaaaaggugagga

SEQ ID NO: 571-572 - skipped (2 entries)

SEQ ID NO: 573 - RNA, 20 nt, Artificial Sequence
  USH2A-209 gRNA targeting domain
uaaaauauauuuaaaaggug

SEQ ID NO: 574 - RNA, 20 nt, Artificial Sequence
  USH2A-212 gRNA targeting domain
uagugcaaaaaagaagccaa

SEQ ID NO: 575 - RNA, 20 nt, Artificial Sequence
  USH2A-212/USH2A-351 gRNA targeting domain
uauauuuaaaaggugaggau

SEQ ID NO: 576 - skipped

SEQ ID NO: 577 - RNA, 20 nt, Artificial Sequence
  USH2A-213 gRNA targeting domain
uuaaauauauuuuaucuuua

SEQ ID NO: 578 - RNA, 20 nt, Artificial Sequence
  USH2A-214 gRNA targeting domain
uuuaaauauauuuuaucuuu

SEQ ID NO: 579-589 - skipped (11 entries)

SEQ ID NO: 590 - RNA, 19 nt, Artificial Sequence
  USH2A-295 gRNA targeting domain
accugcagagaaaacuuuu

SEQ ID NO: 591 - RNA, 20 nt, Artificial Sequence
  USH2A-288 gRNA targeting domain
acugcccagagugaggauug

SEQ ID NO: 592 - RNA, 19 nt, Artificial Sequence
  USH2A-283 gRNA targeting domain
aggugugaucauugcaauu

SEQ ID NO: 593 - RNA, 19 nt, Artificial Sequence
  USH2A-280 gRNA targeting domain
auuacagacagucccaggg

SEQ ID NO: 594 - RNA, 20 nt, Artificial Sequence
  USH2A-294 gRNA targeting domain
caccugcagagaaaacuuuu

SEQ ID NO: 595 - RNA, 18 nt, Artificial Sequence
  USH2A-293 gRNA targeting domain
cacuacacugcccagagu

SEQ ID NO: 596 - skipped

SEQ ID NO: 597 - RNA, 18 nt, Artificial Sequence
  USH2A-296 gRNA targeting domain
ccugcagagaaaacuuuu

SEQ ID NO: 598 - RNA, 18 nt, Artificial Sequence
  USH2A-299 gRNA targeting domain
ccugugacugugacacag

SEQ ID NO: 599 - RNA, 19 nt, Artificial Sequence
  USH2A-277 gRNA targeting domain
cuccgaagcuuuaaugaug

SEQ ID NO: 600 - RNA, 19 nt, Artificial Sequence
  USH2A-289 gRNA targeting domain
cugcccagagugaggauug

SEQ ID NO: 601 - RNA, 20 nt, Artificial Sequence
  USH2A-285 gRNA targeting domain
cuuuuuugcacuacacugcc

SEQ ID NO: 602 - RNA, 20 nt, Artificial Sequence
  USH2A-282 gRNA targeting domain
uaggugugaucauugcaauu

SEQ ID NO: 603 - RNA, 18 nt, Artificial Sequence
  USH2A-278 gRNA targeting domain
uccgaagcuuuaaugaug

SEQ ID NO: 604 - RNA, 20 nt, Artificial Sequence
  USH2A-276 gRNA targeting domain
ucuccgaagcuuuaaugaug

SEQ ID NO: 605 - RNA, 20 nt, Artificial Sequence
  USH2A-291 gRNA targeting domain
ugcacuacacugcccagagu

SEQ ID NO: 606 - RNA, 18 nt, Artificial Sequence
  USH2A-290 gRNA targeting domain
ugcccagagugaggauug

SEQ ID NO: 607 - RNA, 18 nt, Artificial Sequence
  USH2A-281 gRNA targeting domain
uuacagacagucccaggg

SEQ ID NO: 608 - RNA, 18 nt, Artificial Sequence
  USH2A-287 gRNA targeting domain
uuuuugcacuacacugcc

SEQ ID NO: 609 - RNA, 19 nt, Artificial Sequence
  USH2A-286 gRNA targeting domain
uuuuuugcacuacacugcc

SEQ ID NO: 610 - RNA, 22 nt, Artificial Sequence
  USH2A-440 gRNA targeting domain
aaggccugugacugugacacag

SEQ ID NO: 611 - RNA, 24 nt, Artificial Sequence
  USH2A-450 gRNA targeting domain
aauuucuccgaagcuuuaaugaug

SEQ ID NO: 612 - RNA, 21 nt, Artificial Sequence
  USH2A-449 gRNA targeting domain
acaccugcagagaaaacuuuu

SEQ ID NO: 613 - RNA, 22 nt, Artificial Sequence
  USH2A-456 gRNA targeting domain
acacugcccagagugaggauug

SEQ ID NO: 614 - RNA, 22 nt, Artificial Sequence
  USH2A-444 gRNA targeting domain
agcauuacagacagucccaggg

SEQ ID NO: 615 - RNA, 21 nt, Artificial Sequence
  USH2A-441 gRNA targeting domain
aggccugugacugugacacag

SEQ ID NO: 616 - RNA, 23 nt, Artificial Sequence
  USH2A-451 gRNA targeting domain
auuucuccgaagcuuuaaugaug

SEQ ID NO: 617 - RNA, 21 nt, Artificial Sequence
  USH2A-457 gRNA targeting domain
cacugcccagagugaggauug

SEQ ID NO: 618 - RNA, 24 nt, Artificial Sequence
  USH2A-454 gRNA targeting domain
cuacacugcccagagugaggauug

SEQ ID NO: 619 - RNA, 22 nt, Artificial Sequence
  USH2A-428 gRNA targeting domain
cuuaggugugaucauugcaauu

SEQ ID NO: 620 - RNA, 23 nt, Artificial Sequence
  USH2A-431 gRNA targeting domain
cuucuuuuuugcacuacacugcc

SEQ ID NO: 621 - RNA, 23 nt, Artificial Sequence
  USH2A-439 gRNA targeting domain
uaaggccugugacugugacacag

SEQ ID NO: 622 - RNA, 23 nt, Artificial Sequence
  USH2A-455 gRNA targeting domain
uacacugcccagagugaggauug

SEQ ID NO: 623 - RNA, 23 nt, Artificial Sequence
  USH2A-443 gRNA targeting domain
uagcauuacagacagucccaggg

SEQ ID NO: 624 - RNA, 21 nt, Artificial Sequence
  USH2A-433 gRNA targeting domain
ucuuuuuugcacuacacugcc

SEQ ID NO: 625 - RNA, 23 nt, Artificial Sequence
  USH2A-447 gRNA targeting domain
ugacaccugcagagaaaacuuuu

SEQ ID NO: 626 - RNA, 24 nt, Artificial Sequence
  USH2A-442 gRNA targeting domain
uuagcauuacagacagucccaggg

SEQ ID NO: 627 - RNA, 21 nt, Artificial Sequence
  USH2A-429 gRNA targeting domain
uuaggugugaucauugcaauu

SEQ ID NO: 628 - RNA, 21 nt, Artificial Sequence
  USH2A-453 gRNA targeting domain
uucuccgaagcuuuaaugaug

SEQ ID NO: 629 - RNA, 22 nt, Artificial Sequence
  USH2A-432 gRNA targeting domain
uucuuuuuugcacuacacugcc

SEQ ID NO: 630 - RNA, 21 nt, Artificial Sequence
  USH2A-437 gRNA targeting domain
uugcacuacacugcccagagu

SEQ ID NO: 631 - RNA, 22 nt, Artificial Sequence
  USH2A-452 gRNA targeting domain
uuucuccgaagcuuuaaugaug

SEQ ID NO: 632 - RNA, 22 nt, Artificial Sequence
  USH2A-436 gRNA targeting domain
uuugcacuacacugcccagagu

SEQ ID NO: 633 - RNA, 23 nt, Artificial Sequence
  USH2A-435 gRNA targeting domain
uuuugcacuacacugcccagagu

SEQ ID NO: 634 - RNA, 24 nt, Artificial Sequence
  USH2A-434 gRNA targeting domain
uuuuugcacuacacugcccagagu

SEQ ID NO: 635 - RNA, 21 nt, Artificial Sequence
  USH2A-461 gRNA targeting domain
gauaaaauauauuuaaaaggu

SEQ ID NO: 636 - RNA, 20 nt, Artificial Sequence
  USH2A-300 gRNA targeting domain
auaaaauauauuuaaaaggu

SEQ ID NO: 637 - RNA, 19 nt, Artificial Sequence
  USH2A-301 gRNA targeting domain
uaaaauauauuuaaaaggu

SEQ ID NO: 638 - RNA, 18 nt, Artificial Sequence
  USH2A-302 gRNA targeting domain
aaaauauauuuaaaaggu

SEQ ID NO: 639 - RNA, 24 nt, Artificial Sequence
  USH2A-458 gRNA targeting domain
aaagauaaaauauauuuaaaaggu

SEQ ID NO: 640 - RNA, 23 nt, Artificial Sequence
  USH2A-459 gRNA targeting domain
aagauaaaauauauuuaaaaggu

SEQ ID NO: 641 - RNA, 22 nt, Artificial Sequence
  USH2A-460 gRNA targeting domain
agauaaaauauauuuaaaaggu

SEQ ID NO: 642 - skipped

SEQ ID NO: 643 - RNA, 19 nt, Artificial Sequence
  USH2A-304 gRNA targeting domain
uauauuuaaaaggugagga

SEQ ID NO: 644 - RNA, 18 nt, Artificial Sequence
  USH2A-305 gRNA targeting domain
auauuuaaaaggugagga

SEQ ID NO: 645 - RNA, 20 nt, Artificial Sequence
  USH2A-306 gRNA targeting domain
uuuucucugcaggugucaca

SEQ ID NO: 646 - RNA, 19 nt, Artificial Sequence
  USH2A-307 gRNA targeting domain
uuucucugcaggugucaca

SEQ ID NO: 647 - RNA, 18 nt, Artificial Sequence
  USH2A-308 gRNA targeting domain
uucucugcaggugucaca

SEQ ID NO: 648 - RNA, 20 nt, Artificial Sequence
  USH2A-309/USH2A-271 gRNA targeting domain
ugcacugucucccuucaaca

SEQ ID NO: 649 - RNA, 19 nt, Artificial Sequence
  USH2A-310 gRNA targeting domain
gcacugucucccuucaaca

SEQ ID NO: 650 - RNA, 18 nt, Artificial Sequence
  USH2A-311 gRNA targeting domain
cacugucucccuucaaca

SEQ ID NO: 651 - RNA, 20 nt, Artificial Sequence
  USH2A-312 gRNA targeting domain
gugcaucugcaagcccaaug

SEQ ID NO: 652 - RNA, 19 nt, Artificial Sequence
  USH2A-313 gRNA targeting domain
ugcaucugcaagcccaaug

SEQ ID NO: 653 - RNA, 18 nt, Artificial Sequence
  USH2A-314 gRNA targeting domain
gcaucugcaagcccaaug

SEQ ID NO: 654 - RNA, 20 nt, Artificial Sequence
  USH2A-315 gRNA targeting domain
caaauucugcaauccucacu

SEQ ID NO: 655 - RNA, 19 nt, Artificial Sequence
  USH2A-316 gRNA targeting domain
aaauucugcaauccucacu

SEQ ID NO: 656 - RNA, 18 nt, Artificial Sequence
  USH2A-317 gRNA targeting domain
aauucugcaauccucacu

SEQ ID NO: 657 - skipped

SEQ ID NO: 658 - RNA, 19 nt, Artificial Sequence
  USH2A-319 gRNA targeting domain
cugcaagcccaauguugaa

SEQ ID NO: 659 - RNA, 18 nt, Artificial Sequence
  USH2A-320 gRNA targeting domain
ugcaagcccaauguugaa

SEQ ID NO: 660 - skipped

SEQ ID NO: 661 - RNA, 19 nt, Artificial Sequence
  USH2A-322 gRNA targeting domain
uagcauuacagacaguccc

SEQ ID NO: 662 - RNA, 18 nt, Artificial Sequence
  USH2A-323 gRNA targeting domain
agcauuacagacaguccc

SEQ ID NO: 663 - RNA, 20 nt, Artificial Sequence
  USH2A-324 gRNA targeting domain
gacagugcaauaaauguuug

SEQ ID NO: 664 - RNA, 19 nt, Artificial Sequence
  USH2A-325 gRNA targeting domain
acagugcaauaaauguuug

SEQ ID NO: 665 - RNA, 18 nt, Artificial Sequence
  USH2A-326 gRNA targeting domain
cagugcaauaaauguuug

SEQ ID NO: 666 - RNA, 20 nt, Artificial Sequence
  USH2A-327 gRNA targeting domain
ugacacagcuggaucccucc

SEQ ID NO: 667 - RNA, 19 nt, Artificial Sequence
  USH2A-328 gRNA targeting domain
gacacagcuggaucccucc

SEQ ID NO: 668 - RNA, 18 nt, Artificial Sequence
  USH2A-329 gRNA targeting domain
acacagcuggaucccucc

SEQ ID NO: 669 - RNA, 20 nt, Artificial Sequence
  USH2A-330 gRNA targeting domain
cuuagcauuacagacagucc

SEQ ID NO: 670 - RNA, 19 nt, Artificial Sequence
  USH2A-331 gRNA targeting domain
uuagcauuacagacagucc

SEQ ID NO: 671 - RNA, 18 nt, Artificial Sequence
  USH2A-332 gRNA targeting domain
uagcauuacagacagucc

SEQ ID NO: 672 - RNA, 20 nt, Artificial Sequence
  USH2A-333 gRNA targeting domain
aauuuuggauuuaaauuucu

SEQ ID NO: 673 - RNA, 19 nt, Artificial Sequence
  USH2A-334 gRNA targeting domain
auuuuggauuuaaauuucu

SEQ ID NO: 674 - RNA, 18 nt, Artificial Sequence
  USH2A-335 gRNA targeting domain
uuuuggauuuaaauuucu

SEQ ID NO: 675 - RNA, 20 nt, Artificial Sequence
  USH2A-336 gRNA targeting domain
uuugcacuacacugcccaga

SEQ ID NO: 676 - RNA, 19 nt, Artificial Sequence
  USH2A-337 gRNA targeting domain
uugcacuacacugcccaga

SEQ ID NO: 677 - RNA, 18 nt, Artificial Sequence
  USH2A-338 gRNA targeting domain
ugcacuacacugcccaga

SEQ ID NO: 678 - RNA, 20 nt, Artificial Sequence
  USH2A-339 gRNA targeting domain
ggagacagugcaauaaaugu

SEQ ID NO: 679 - RNA, 19 nt, Artificial Sequence
  USH2A-340 gRNA targeting domain
gagacagugcaauaaaugu

SEQ ID NO: 680 - RNA, 18 nt, Artificial Sequence
  USH2A-341 gRNA targeting domain
agacagugcaauaaaugu

SEQ ID NO: 681 - RNA, 20 nt, Artificial Sequence
  USH2A-342 gRNA targeting domain
aaugauuucauucaagauag

SEQ ID NO: 682 - RNA, 19 nt, Artificial Sequence
  USH2A-343 gRNA targeting domain
augauuucauucaagauag

SEQ ID NO: 683 - RNA, 18 nt, Artificial Sequence
  USH2A-344 gRNA targeting domain
ugauuucauucaagauag

SEQ ID NO: 684 - skipped

SEQ ID NO: 685 - RNA, 19 nt, Artificial Sequence
  USH2A-346 gRNA targeting domain
cagugcaauaaauguuugg

SEQ ID NO: 686 - RNA, 18 nt, Artificial Sequence
  USH2A-347 gRNA targeting domain
agugcaauaaauguuugg

SEQ ID NO: 687 - RNA, 20 nt, Artificial Sequence
  USH2A-348 gRNA targeting domain
agauaaaauauauuuaaaag

SEQ ID NO: 688 - RNA, 19 nt, Artificial Sequence
  USH2A-349 gRNA targeting domain
gauaaaauauauuuaaaag

SEQ ID NO: 689 - RNA, 18 nt, Artificial Sequence
  USH2A-350 gRNA targeting domain
auaaaauauauuuaaaag

SEQ ID NO: 690 - skipped

SEQ ID NO: 691 - RNA, 19 nt, Artificial Sequence
  USH2A-352 gRNA targeting domain
auauuuaaaaggugaggau

SEQ ID NO: 692 - RNA, 18 nt, Artificial Sequence
  USH2A-353 gRNA targeting domain
uauuuaaaaggugaggau

SEQ ID NO: 693 - RNA, 20 nt, Artificial Sequence
  USH2A-354 gRNA targeting domain
cugggcaguguagugcaaaa

SEQ ID NO: 694 - RNA, 19 nt, Artificial Sequence
  USH2A-355 gRNA targeting domain
ugggcaguguagugcaaaa

SEQ ID NO: 695 - RNA, 18 nt, Artificial Sequence
  USH2A-356 gRNA targeting domain
gggcaguguagugcaaaa

SEQ ID NO: 696 - RNA, 20 nt, Artificial Sequence
  USH2A-357 gRNA targeting domain
ccaacaucauuaaagcuucg

SEQ ID NO: 697 - RNA, 19 nt, Artificial Sequence
  USH2A-358 gRNA targeting domain
caacaucauuaaagcuucg

SEQ ID NO: 698 - RNA, 18 nt, Artificial Sequence
  USH2A-359 gRNA targeting domain
aacaucauuaaagcuucg

SEQ ID NO: 699 - RNA, 20 nt, Artificial Sequence
  USH2A-360 gRNA targeting domain
uugugucucgucuaucuuga

SEQ ID NO: 700 - RNA, 19 nt, Artificial Sequence
  USH2A-361 gRNA targeting domain
ugugucucgucuaucuuga

SEQ ID NO: 701 - RNA, 18 nt, Artificial Sequence
  USH2A-362 gRNA targeting domain
gugucucgucuaucuuga

SEQ ID NO: 702 - skipped

SEQ ID NO: 703 - RNA, 19 nt, Artificial Sequence
  USH2A-364 gRNA targeting domain
agcauuacagacaguccca

SEQ ID NO: 704 - RNA, 18 nt, Artificial Sequence
  USH2A-365 gRNA targeting domain
gcauuacagacaguccca

SEQ ID NO: 705 - skipped

SEQ ID NO: 706 - RNA, 19 nt, Artificial Sequence
  USH2A-367 gRNA targeting domain
ucugcaagcccaauguuga

SEQ ID NO: 707 - RNA, 18 nt, Artificial Sequence
  USH2A-368 gRNA targeting domain
cugcaagcccaauguuga

SEQ ID NO: 708 - RNA, 20 nt, Artificial Sequence
  USH2A-369/USH2A-272 gRNA targeting domain
uuuuaaauauauuuuaucuu

SEQ ID NO: 709 - RNA, 19 nt, Artificial Sequence
  USH2A-370 gRNA targeting domain
uuuaaauauauuuuaucuu

SEQ ID NO: 710 - RNA, 18 nt, Artificial Sequence
  USH2A-371 gRNA targeting domain
uuaaauauauuuuaucuu

SEQ ID NO: 711 - RNA, 20 nt, Artificial Sequence
  USH2A-372 gRNA targeting domain
cauccaacaucauuaaagcu

SEQ ID NO: 712 - RNA, 19 nt, Artificial Sequence
  USH2A-373 gRNA targeting domain
auccaacaucauuaaagcu

SEQ ID NO: 713 - RNA, 18 nt, Artificial Sequence
  USH2A-374 gRNA targeting domain
uccaacaucauuaaagcu

SEQ ID NO: 714 - RNA, 20 nt, Artificial Sequence
  USH2A-375 gRNA targeting domain
gcauuacagacagucccagg

SEQ ID NO: 715 - RNA, 19 nt, Artificial Sequence
  USH2A-376 gRNA targeting domain
cauuacagacagucccagg

SEQ ID NO: 716 - RNA, 18 nt, Artificial Sequence
  USH2A-377 gRNA targeting domain
auuacagacagucccagg

SEQ ID NO: 717 - RNA, 20 nt, Artificial Sequence
  USH2A-378 gRNA targeting domain
cagaauuuguucacugagcc

SEQ ID NO: 718 - RNA, 19 nt, Artificial Sequence
  USH2A-379 gRNA targeting domain
agaauuuguucacugagcc

SEQ ID NO: 719 - RNA, 18 nt, Artificial Sequence
  USH2A-380 gRNA targeting domain
gaauuuguucacugagcc

SEQ ID NO: 720 - RNA, 20 nt, Artificial Sequence
  USH2A-381 gRNA targeting domain
acuucagugugacaccugca

SEQ ID NO: 721 - RNA, 19 nt, Artificial Sequence
  USH2A-382 gRNA targeting domain
cuucagugugacaccugca

SEQ ID NO: 722 - RNA, 18 nt, Artificial Sequence
  USH2A-383 targeting domain
uucagugugacaccugca

SEQ ID NO: 723 - skipped

SEQ ID NO: 724 - RNA, 19 nt, Artificial Sequence
  USH2A-385 targeting domain
agugcaauaaauguuugga

SEQ ID NO: 725 - RNA, 18 nt, Artificial Sequence
  USH2A-386 targeting domain
gugcaauaaauguuugga

SEQ ID NO: 726 - skipped

SEQ ID NO: 727 - RNA, 19 nt, Artificial Sequence
  USH2A-388 targeting domain
agacagugcaauaaauguu

SEQ ID NO: 728 - RNA, 18 nt, Artificial Sequence
  USH2A-389 targeting domain
gacagugcaauaaauguu

SEQ ID NO: 729 - RNA, 20 nt, Artificial Sequence
  USH2A-390 targeting domain
aagcuuuaaugauguuggau

SEQ ID NO: 730 - RNA, 19 nt, Artificial Sequence
  USH2A-391 targeting domain
agcuuuaaugauguuggau

SEQ ID NO: 731 - RNA, 18 nt, Artificial Sequence
  USH2A-392 targeting domain
gcuuuaaugauguuggau

SEQ ID NO: 732 - RNA, 20 nt, Artificial Sequence
  USH2A-393 targeting domain
aauauauuuaaaaggugagg

SEQ ID NO: 733 - RNA, 19 nt, Artificial Sequence
  USH2A-394 targeting domain
auauauuuaaaaggugagg

SEQ ID NO: 734 - RNA, 18 nt, Artificial Sequence
  USH2A-395 targeting domain
uauauuuaaaaggugagg

SEQ ID NO: 735 - RNA, 20 nt, Artificial Sequence
  USH2A-396 targeting domain
ggacuucagugugacaccug

SEQ ID NO: 736 - RNA, 19 nt, Artificial Sequence
  USH2A-397 targeting domain
gacuucagugugacaccug

SEQ ID NO: 737 - RNA, 18 nt, Artificial Sequence
  USH2A-398 targeting domain
acuucagugugacaccug

SEQ ID NO: 738 - skipped

SEQ ID NO: 739 - RNA, 19 nt, Artificial Sequence
  USH2A-400 targeting domain
uccaacaucauuaaagcuu

SEQ ID NO: 740 - RNA, 18 nt, Artificial Sequence
  USH2A-401 targeting domain
ccaacaucauuaaagcuu

SEQ ID NO: 741 - RNA, 20 nt, Artificial Sequence
  USH2A-402 targeting domain
aguguaaccuccauggcuca

SEQ ID NO: 742 - RNA, 19 nt, Artificial Sequence
  USH2A-403 targeting domain
guguaaccuccauggcuca

SEQ ID NO: 743 - RNA, 18 nt, Artificial Sequence
  USH2A-404 targeting domain
uguaaccuccauggcuca

SEQ ID NO: 744 - skipped

SEQ ID NO: 745 - RNA, 19 nt, Artificial Sequence
  USH2A-406 targeting domain
gaauuuguucacugagcca

SEQ ID NO: 746 - RNA, 18 nt, Artificial Sequence
  USH2A-407 targeting domain
aauuuguucacugagcca

SEQ ID NO: 747 - RNA, 20 nt, Artificial Sequence
  USH2A-408 targeting domain
guagugcaaaaaagaagcca

SEQ ID NO: 748 - RNA, 19 nt, Artificial Sequence
  USH2A-409 targeting domain
uagugcaaaaaagaagcca

SEQ ID NO: 749 - RNA, 18 nt, Artificial Sequence
  USH2A-410 targeting domain
agugcaaaaaagaagcca

SEQ ID NO: 750 - RNA, 20 nt, Artificial Sequence
  USH2A-411 gRNA targeting domain
caucugcaagcccaauguug

SEQ ID NO: 751 - RNA, 19 nt, Artificial Sequence
  USH2A-412 gRNA targeting domain
aucugcaagcccaauguug

SEQ ID NO: 752 - RNA, 18 nt, Artificial Sequence
  USH2A-413 gRNA targeting domain
ucugcaagcccaauguug

SEQ ID NO: 753 - RNA, 20 nt, Artificial Sequence
  USH2A-414 gRNA targeting domain
gacugucuguaaugcuaaga

SEQ ID NO: 754 - RNA, 19 nt, Artificial Sequence
  USH2A-415 targeting domain
acugucuguaaugcuaaga

SEQ ID NO: 755 - RNA, 18 nt, Artificial Sequence
  USH2A-416 targeting domain
cugucuguaaugcuaaga

SEQ ID NO: 756 - skipped

SEQ ID NO: 757 - RNA, 19 nt, Artificial Sequence
  USH2A-418 targeting domain
acacagcuggaucccuccc

SEQ ID NO: 758 - RNA, 18 nt, Artificial Sequence
  USH2A-419 targeting domain
cacagcuggaucccuccc

SEQ ID NO: 759 - RNA, 20 nt, Artificial Sequence
  USH2A-420 targeting domain
aggauugcagaauuuguuca

SEQ ID NO: 760 - RNA, 19 nt, Artificial Sequence
  USH2A-421 targeting domain
ggauugcagaauuuguuca

SEQ ID NO: 761 - RNA, 18 nt, Artificial Sequence
  USH2A-422 targeting domain
gauugcagaauuuguuca

SEQ ID NO: 762 - RNA, 20 nt, Artificial Sequence
  USH2A-423 targeting domain
agccauggagguuacacugg

SEQ ID NO: 763 - RNA, 19 nt, Artificial Sequence
  USH2A-424 targeting domain
gccauggagguuacacugg

SEQ ID NO: 764 - RNA, 18 nt, Artificial Sequence
  USH2A-425 targeting domain
ccauggagguuacacugg

SEQ ID NO: 765 - RNA, 24 nt, Artificial Sequence
  USH2A-462 targeting domain
cucacauccaacaucauuaaagcu

SEQ ID NO: 766 - RNA, 23 nt, Artificial Sequence
  USH2A-463 targeting domain
ucacauccaacaucauuaaagcu

SEQ ID NO: 767 - RNA, 22 nt, Artificial Sequence
  USH2A-464 targeting domain
cacauccaacaucauuaaagcu

SEQ ID NO: 768 - RNA, 21 nt, Artificial Sequence
  USH2A-465 targeting domain
acauccaacaucauuaaagcu

SEQ ID NO: 769 - RNA, 24 nt, Artificial Sequence
  USH2A-466 targeting domain
auugcagaauuuguucacugagcc

SEQ ID NO: 770 - RNA, 23 nt, Artificial Sequence
  USH2A-467 targeting domain
uugcagaauuuguucacugagcc

SEQ ID NO: 771 - RNA, 22 nt, Artificial Sequence
  USH2A-468 targeting domain
ugcagaauuuguucacugagcc

SEQ ID NO: 772 - RNA, 21 nt, Artificial Sequence
  USH2A-469 targeting domain
gcagaauuuguucacugagcc

SEQ ID NO: 773 - RNA, 24 nt, Artificial Sequence
  USH2A-470 targeting domain
cugggacugucuguaaugcuaaga

SEQ ID NO: 774 - RNA, 23 nt, Artificial Sequence
  USH2A-471 targeting domain
ugggacugucuguaaugcuaaga

SEQ ID NO: 775 - RNA, 22 nt, Artificial Sequence
  USH2A-472 targeting domain
gggacugucuguaaugcuaaga

SEQ ID NO: 776 - RNA, 21 nt, Artificial Sequence
  USH2A-473 targeting domain
ggacugucuguaaugcuaaga

SEQ ID NO: 777 - RNA, 24 nt, Artificial Sequence
  USH2A-474 targeting domain
uugcagaauuuguucacugagcca

SEQ ID NO: 778 - RNA, 23 nt, Artificial Sequence
  USH2A-475 targeting domain
ugcagaauuuguucacugagcca

SEQ ID NO: 779 - RNA, 22 nt, Artificial Sequence
  USH2A-476 targeting domain
gcagaauuuguucacugagcca

SEQ ID NO: 780 - RNA, 21 nt, Artificial Sequence
  USH2A-477 targeting domain
cagaauuuguucacugagcca

SEQ ID NO: 781 - RNA, 24 nt, Artificial Sequence
  USH2A-478 gRNA targeting domain
gaagggagacagugcaauaaaugu

SEQ ID NO: 782 - RNA, 23 nt, Artificial Sequence
  USH2A-479 targeting domain
aagggagacagugcaauaaaugu

SEQ ID NO: 783 - RNA, 22 nt, Artificial Sequence
  USH2A-480 targeting domain
agggagacagugcaauaaaugu

SEQ ID NO: 784 - RNA, 21 nt, Artificial Sequence
  USH2A-481 targeting domain
gggagacagugcaauaaaugu

SEQ ID NO: 785 - RNA, 24 nt, Artificial Sequence
  USH2A-482 targeting domain
aaaguuuucucugcaggugucaca

SEQ ID NO: 786 - RNA, 23 nt, Artificial Sequence
  USH2A-483 targeting domain
aaguuuucucugcaggugucaca

SEQ ID NO: 787 - RNA, 22 nt, Artificial Sequence
  USH2A-484 targeting domain
aguuuucucugcaggugucaca

SEQ ID NO: 788 - RNA, 21 nt, Artificial Sequence
  USH2A-485 targeting domain
guuuucucugcaggugucaca

SEQ ID NO: 789 - RNA, 24 nt, Artificial Sequence
  USH2A-486 targeting domain
cuuagcauuacagacagucccagg

SEQ ID NO: 790 - RNA, 23 nt, Artificial Sequence
  USH2A-487 targeting domain
uuagcauuacagacagucccagg

SEQ ID NO: 791 - RNA, 22 nt, Artificial Sequence
  USH2A-488 targeting domain
uagcauuacagacagucccagg

SEQ ID NO: 792 - RNA, 21 nt, Artificial Sequence
  USH2A-489 targeting domain
agcauuacagacagucccagg

SEQ ID NO: 793 - RNA, 24 nt, Artificial Sequence
  USH2A-490 targeting domain
cuaaagauaaaauauauuuaaaag

SEQ ID NO: 794 - RNA, 23 nt, Artificial Sequence
  USH2A-491 targeting domain
uaaagauaaaauauauuuaaaag

SEQ ID NO: 795 - RNA, 22 nt, Artificial Sequence
  USH2A-492 targeting domain
aaagauaaaauauauuuaaaag

SEQ ID NO: 796 - RNA, 21 nt, Artificial Sequence
  USH2A-493 targeting domain
aagauaaaauauauuuaaaag

SEQ ID NO: 797 - RNA, 24 nt, Artificial Sequence
  USH2A-494 targeting domain
ugcaucugcaagcccaauguugaa

SEQ ID NO: 798 - RNA, 23 nt, Artificial Sequence
  USH2A-495 targeting domain
gcaucugcaagcccaauguugaa

SEQ ID NO: 799 - RNA, 22 nt, Artificial Sequence
  USH2A-496 targeting domain
caucugcaagcccaauguugaa

SEQ ID NO: 800 - RNA, 21 nt, Artificial Sequence
  USH2A-497 targeting domain
aucugcaagcccaauguugaa

SEQ ID NO: 801 - RNA, 24 nt, Artificial Sequence
  USH2A-498 targeting domain
acugagccauggagguuacacugg

SEQ ID NO: 802 - RNA, 23 nt, Artificial Sequence
  USH2A-499 targeting domain
cugagccauggagguuacacugg

SEQ ID NO: 803 - RNA, 22 nt, Artificial Sequence
  USH2A-500 targeting domain
ugagccauggagguuacacugg

SEQ ID NO: 804 - RNA, 21 nt, Artificial Sequence
  USH2A-501 targeting domain
gagccauggagguuacacugg

SEQ ID NO: 805 - RNA, 24 nt, Artificial Sequence
  USH2A-502 targeting domain
aaggacuucagugugacaccugca

SEQ ID NO: 806 - RNA, 23 nt, Artificial Sequence
  USH2A-503 targeting domain
aggacuucagugugacaccugca

SEQ ID NO: 807 - RNA, 22 nt, Artificial Sequence
  USH2A-504 targeting domain
ggacuucagugugacaccugca

SEQ ID NO: 808 - RNA, 21 nt, Artificial Sequence
  USH2A-505 targeting domain
gacuucagugugacaccugca

SEQ ID NO: 809 - RNA, 24 nt, Artificial Sequence
  USH2A-506 targeting domain
agugaggauugcagaauuuguuca

SEQ ID NO: 810 - RNA, 23 nt, Artificial Sequence
  USH2A-507 targeting domain
gugaggauugcagaauuuguuca

SEQ ID NO: 811 - RNA, 22 nt, Artificial Sequence
  USH2A-508 targeting domain
ugaggauugcagaauuuguuca

SEQ ID NO: 812 - RNA, 21 nt, Artificial Sequence
  USH2A-509 targeting domain
gaggauugcagaauuuguuca

SEQ ID NO: 813 - RNA, 24 nt, Artificial Sequence
  USH2A-510 targeting domain
uaaaauauauuuaaaaggugagga

SEQ ID NO: 814 - RNA, 23 nt, Artificial Sequence
  USH2A-511 targeting domain
aaaauauauuuaaaaggugagga

SEQ ID NO: 815 - RNA, 22 nt, Artificial Sequence
  USH2A-512 targeting domain
aaauauauuuaaaaggugagga

SEQ ID NO: 816 - RNA, 21 nt, Artificial Sequence
  USH2A-513 targeting domain
aauauauuuaaaaggugagga

SEQ ID NO: 817 - RNA, 24 nt, Artificial Sequence
  USH2A-514 targeting domain
cugugacacagcuggaucccuccc

SEQ ID NO: 818 - RNA, 23 nt, Artificial Sequence
  USH2A-515 targeting domain
ugugacacagcuggaucccuccc

SEQ ID NO: 819 - RNA, 22 nt, Artificial Sequence
  USH2A-516 targeting domain
gugacacagcuggaucccuccc

SEQ ID NO: 820 - RNA, 21 nt, Artificial Sequence
  USH2A-517 targeting domain
ugacacagcuggaucccuccc

SEQ ID NO: 821 - RNA, 24 nt, Artificial Sequence
  USH2A-518 targeting domain
cugucuuagcauuacagacagucc

SEQ ID NO: 822 - RNA, 23 nt, Artificial Sequence
  USH2A-519 targeting domain
ugucuuagcauuacagacagucc

SEQ ID NO: 823 - RNA, 22 nt, Artificial Sequence
  USH2A-520 targeting domain
gucuuagcauuacagacagucc

SEQ ID NO: 824 - RNA, 21 nt, Artificial Sequence
  USH2A-521 targeting domain
ucuuagcauuacagacagucc

SEQ ID NO: 825 - RNA, 24 nt, Artificial Sequence
  USH2A-522 targeting domain
ugaacaaauucugcaauccucacu

SEQ ID NO: 826 - RNA, 23 nt, Artificial Sequence
  USH2A-523 targeting domain
gaacaaauucugcaauccucacu

SEQ ID NO: 827 - RNA, 22 nt, Artificial Sequence
  USH2A-524 targeting domain
aacaaauucugcaauccucacu

SEQ ID NO: 828 - RNA, 21 nt, Artificial Sequence
  USH2A-525 targeting domain
acaaauucugcaauccucacu

SEQ ID NO: 829 - RNA, 24 nt, Artificial Sequence
  USH2A-526 targeting domain
caaaggacuucagugugacaccug

SEQ ID NO: 830 - RNA, 23 nt, Artificial Sequence
  USH2A-527 targeting domain
aaaggacuucagugugacaccug

SEQ ID NO: 831 - RNA, 22 nt, Artificial Sequence
  USH2A-528 targeting domain
aaggacuucagugugacaccug

SEQ ID NO: 832 - RNA, 21 nt, Artificial Sequence
  USH2A-529 targeting domain
aggacuucagugugacaccug

SEQ ID NO: 833 - RNA, 24 nt, Artificial Sequence
  USH2A-530 targeting domain
caccuuuuaaauauauuuuaucuu

SEQ ID NO: 834 - RNA, 23 nt, Artificial Sequence
  USH2A-531 targeting domain
accuuuuaaauauauuuuaucuu

SEQ ID NO: 835 - RNA, 22 nt, Artificial Sequence
  USH2A-532 targeting domain
ccuuuuaaauauauuuuaucuu

SEQ ID NO: 836 - RNA, 21 nt, Artificial Sequence
  USH2A-533 targeting domain
cuuuuaaauauauuuuaucuu

SEQ ID NO: 837 - RNA, 24 nt, Artificial Sequence
  USH2A-534 targeting domain
gugcaucugcaagcccaauguuga

SEQ ID NO: 838 - RNA, 23 nt, Artificial Sequence
  USH2A-535 targeting domain
ugcaucugcaagcccaauguuga

SEQ ID NO: 839 - RNA, 22 nt, Artificial Sequence
  USH2A-536 targeting domain
gcaucugcaagcccaauguuga

SEQ ID NO: 840 - RNA, 21 nt, Artificial Sequence
  USH2A-537 targeting domain
caucugcaagcccaauguuga

SEQ ID NO: 841 - RNA, 24 nt, Artificial Sequence
  USH2A-538 targeting domain
gucuuagcauuacagacaguccca

SEQ ID NO: 842 - RNA, 23 nt, Artificial Sequence
  USH2A-539 targeting domain
ucuuagcauuacagacaguccca

SEQ ID NO: 843 - RNA, 22 nt, Artificial Sequence
  USH2A-540 targeting domain
cuuagcauuacagacaguccca

SEQ ID NO: 844 - RNA, 21 nt, Artificial Sequence
  USH2A-541 targeting domain
uuagcauuacagacaguccca

SEQ ID NO: 845 - RNA, 24 nt, Artificial Sequence
  USH2A-542 targeting domain
agugcaucugcaagcccaauguug

SEQ ID NO: 846 - RNA, 23 nt, Artificial Sequence
  USH2A-543 targeting domain
gugcaucugcaagcccaauguug

SEQ ID NO: 847 - RNA, 22 nt, Artificial Sequence
  USH2A-544 targeting domain
ugcaucugcaagcccaauguug

SEQ ID NO: 848 - RNA, 21 nt, Artificial Sequence
  USH2A-545 targeting domain
gcaucugcaagcccaauguug

SEQ ID NO: 849 - RNA, 24 nt, Artificial Sequence
  USH2A-546 targeting domain
cacucugggcaguguagugcaaaa

SEQ ID NO: 850 - RNA, 23 nt, Artificial Sequence
  USH2A-547 targeting domain
acucugggcaguguagugcaaaa

SEQ ID NO: 851 - RNA, 22 nt, Artificial Sequence
  USH2A-548 targeting domain
cucugggcaguguagugcaaaa

SEQ ID NO: 852 - RNA, 21 nt, Artificial Sequence
  USH2A-549 targeting domain
ucugggcaguguagugcaaaa

SEQ ID NO: 853 - RNA, 24 nt, Artificial Sequence
  USH2A-550 targeting domain
ugucuuagcauuacagacaguccc

SEQ ID NO: 854 - RNA, 23 nt, Artificial Sequence
  USH2A-551 targeting domain
gucuuagcauuacagacaguccc

SEQ ID NO: 855 - RNA, 22 nt, Artificial Sequence
  USH2A-552 targeting domain
ucuuagcauuacagacaguccc

SEQ ID NO: 856 - RNA, 21 nt, Artificial Sequence
  USH2A-553 targeting domain
cuuagcauuacagacaguccc

SEQ ID NO: 857 - RNA, 24 nt, Artificial Sequence
  USH2A-554 targeting domain
cuuuuuugcacuacacugcccaga

SEQ ID NO: 858 - RNA, 23 nt, Artificial Sequence
  USH2A-555 targeting domain
uuuuuugcacuacacugcccaga

SEQ ID NO: 859 - RNA, 22 nt, Artificial Sequence
  USH2A-556 targeting domain
uuuuugcacuacacugcccaga

SEQ ID NO: 860 - RNA, 21 nt, Artificial Sequence
  USH2A-557 targeting domain
uuuugcacuacacugcccaga

SEQ ID NO: 861 - RNA, 24 nt, Artificial Sequence
  USH2A-558 targeting domain
caguguagugcaaaaaagaagcca

SEQ ID NO: 862 - RNA, 23 nt, Artificial Sequence
  USH2A-559 targeting domain
aguguagugcaaaaaagaagcca

SEQ ID NO: 863 - RNA, 22 nt, Artificial Sequence
  USH2A-560 targeting domain
guguagugcaaaaaagaagcca

SEQ ID NO: 864 - RNA, 21 nt, Artificial Sequence
  USH2A-561 targeting domain
uguagugcaaaaaagaagcca

SEQ ID NO: 865 - RNA, 24 nt, Artificial Sequence
  USH2A-562 targeting domain
aaaauauauuuaaaaggugaggau

SEQ ID NO: 866 - RNA, 23 nt, Artificial Sequence
  USH2A-563 targeting domain
aaauauauuuaaaaggugaggau

SEQ ID NO: 867 - RNA, 22 nt, Artificial Sequence
  USH2A-564 targeting domain
aauauauuuaaaaggugaggau

SEQ ID NO: 868 - RNA, 21 nt, Artificial Sequence
  USH2A-565 targeting domain
auauauuuaaaaggugaggau

SEQ ID NO: 869 - RNA, 24 nt, Artificial Sequence
  USH2A-566 targeting domain
acugugacacagcuggaucccucc

SEQ ID NO: 870 - RNA, 23 nt, Artificial Sequence
  USH2A-567 targeting domain
cugugacacagcuggaucccucc

SEQ ID NO: 871 - RNA, 22 nt, Artificial Sequence
  USH2A-568 targeting domain
ugugacacagcuggaucccucc

SEQ ID NO: 872 - RNA, 21 nt, Artificial Sequence
  USH2A-569 targeting domain
gugacacagcuggaucccucc

SEQ ID NO: 873 - RNA, 24 nt, Artificial Sequence
  USH2A-570 targeting domain
ugccaguguaaccuccauggcuca

SEQ ID NO: 874 - RNA, 23 nt, Artificial Sequence
  USH2A-571 targeting domain
gccaguguaaccuccauggcuca

SEQ ID NO: 875 - RNA, 22 nt, Artificial Sequence
  USH2A-572 targeting domain
ccaguguaaccuccauggcuca

SEQ ID NO: 876 - RNA, 21 nt, Artificial Sequence
  USH2A-573 targeting domain
caguguaaccuccauggcuca

SEQ ID NO: 877 - RNA, 24 nt, Artificial Sequence
  USH2A-574 targeting domain
uugcaauuuuggauuuaaauuucu

SEQ ID NO: 878 - RNA, 23 nt, Artificial Sequence
  USH2A-575 targeting domain
ugcaauuuuggauuuaaauuucu

SEQ ID NO: 879 - RNA, 22 nt, Artificial Sequence
  USH2A-576 targeting domain
gcaauuuuggauuuaaauuucu

SEQ ID NO: 880 - RNA, 21 nt, Artificial Sequence
  USH2A-577 targeting domain
caauuuuggauuuaaauuucu

SEQ ID NO: 881 - RNA, 24 nt, Artificial Sequence
  USH2A-578 targeting domain
gagacagugcaauaaauguuugga

SEQ ID NO: 882 - RNA, 23 nt, Artificial Sequence
  USH2A-579 targeting domain
agacagugcaauaaauguuugga

SEQ ID NO: 883 - RNA, 22 nt, Artificial Sequence
  USH2A-580 targeting domain
gacagugcaauaaauguuugga

SEQ ID NO: 884 - RNA, 21 nt, Artificial Sequence
  USH2A-581 targeting domain
acagugcaauaaauguuugga

SEQ ID NO: 885 - RNA, 24 nt, Artificial Sequence
  USH2A-582 targeting domain
ggaaaaugauuucauucaagauag

SEQ ID NO: 886 - RNA, 23 nt, Artificial Sequence
  USH2A-583 targeting domain
gaaaaugauuucauucaagauag

SEQ ID NO: 887 - RNA, 22 nt, Artificial Sequence
  USH2A-584 targeting domain
aaaaugauuucauucaagauag

SEQ ID NO: 888 - RNA, 21 nt, Artificial Sequence
  USH2A-585 targeting domain
aaaugauuucauucaagauag

SEQ ID NO: 889 - RNA, 24 nt, Artificial Sequence
  USH2A-586 targeting domain
auaaaauauauuuaaaaggugagg

SEQ ID NO: 890 - RNA, 23 nt, Artificial Sequence
  USH2A-587 targeting domain
uaaaauauauuuaaaaggugagg

SEQ ID NO: 891 - RNA, 22 nt, Artificial Sequence
  USH2A-588 targeting domain
aaaauauauuuaaaaggugagg

SEQ ID NO: 892 - RNA, 21 nt, Artificial Sequence
  USH2A-589 targeting domain
aaauauauuuaaaaggugagg

SEQ ID NO: 893 - RNA, 24 nt, Artificial Sequence
  USH2A-590 targeting domain
aagggagacagugcaauaaauguu

SEQ ID NO: 894 - RNA, 23 nt, Artificial Sequence
  USH2A-591 targeting domain
agggagacagugcaauaaauguu

SEQ ID NO: 895 - RNA, 22 nt, Artificial Sequence
  USH2A-592 targeting domain
gggagacagugcaauaaauguu

SEQ ID NO: 896 - RNA, 21 nt, Artificial Sequence
  USH2A-593 targeting domain
ggagacagugcaauaaauguu

SEQ ID NO: 897 - RNA, 24 nt, Artificial Sequence
  USH2A-594 targeting domain
ucacauccaacaucauuaaagcuu

SEQ ID NO: 898 - RNA, 23 nt, Artificial Sequence
  USH2A-595 targeting domain
cacauccaacaucauuaaagcuu

SEQ ID NO: 899 - RNA, 22 nt, Artificial Sequence
  USH2A-596 targeting domain
acauccaacaucauuaaagcuu

SEQ ID NO: 900 - RNA, 21 nt, Artificial Sequence
  USH2A-597 targeting domain
cauccaacaucauuaaagcuu

SEQ ID NO: 901 - RNA, 24 nt, Artificial Sequence
  USH2A-598 targeting domain
ggagacagugcaauaaauguuugg

SEQ ID NO: 902 - RNA, 23 nt, Artificial Sequence
  USH2A-599 targeting domain
gagacagugcaauaaauguuugg

SEQ ID NO: 903 - RNA, 22 nt, Artificial Sequence
  USH2A-600 targeting domain
agacagugcaauaaauguuugg

SEQ ID NO: 904 - RNA, 21 nt, Artificial Sequence
  USH2A-601 targeting domain
gacagugcaauaaauguuugg

SEQ ID NO: 905 - RNA, 24 nt, Artificial Sequence
  USH2A-602 targeting domain
uuauugcacugucucccuucaaca

SEQ ID NO: 906 - RNA, 23 nt, Artificial Sequence
  USH2A-603 targeting domain
uauugcacugucucccuucaaca

SEQ ID NO: 907 - RNA, 22 nt, Artificial Sequence
  USH2A-604 targeting domain
auugcacugucucccuucaaca

SEQ ID NO: 908 - RNA, 21 nt, Artificial Sequence
  USH2A-605 targeting domain
uugcacugucucccuucaaca

SEQ ID NO: 909 - RNA, 24 nt, Artificial Sequence
  USH2A-606 targeting domain
acauccaacaucauuaaagcuucg

SEQ ID NO: 910 - RNA, 23 nt, Artificial Sequence
  USH2A-607 targeting domain
cauccaacaucauuaaagcuucg

SEQ ID NO: 911 - RNA, 22 nt, Artificial Sequence
  USH2A-608 targeting domain
auccaacaucauuaaagcuucg

SEQ ID NO: 912 - RNA, 21 nt, Artificial Sequence
  USH2A-609 targeting domain
uccaacaucauuaaagcuucg

SEQ ID NO: 913 - RNA, 24 nt, Artificial Sequence
  USH2A-610 gRNA targeting domain
uccgaagcuuuaaugauguuggau

SEQ ID NO: 914 - RNA, 23 nt, Artificial Sequence
  USH2A-611 gRNA targeting domain
ccgaagcuuuaaugauguuggau

SEQ ID NO: 915 - RNA, 22 nt, Artificial Sequence
  USH2A-612 gRNA targeting domain
cgaagcuuuaaugauguuggau

SEQ ID NO: 916 - RNA, 21 nt, Artificial Sequence
  USH2A-613 gRNA targeting domain
gaagcuuuaaugauguuggau

SEQ ID NO: 917 - RNA, 24 nt, Artificial Sequence
  USH2A-614 gRNA targeting domain
ggcagugcaucugcaagcccaaug

SEQ ID NO: 918 - RNA, 23 nt, Artificial Sequence
  USH2A-615 gRNA targeting domain
gcagugcaucugcaagcccaaug

SEQ ID NO: 919 - RNA, 22 nt, Artificial Sequence
  USH2A-616 gRNA targeting domain
cagugcaucugcaagcccaaug

SEQ ID NO: 920 - RNA, 21 nt, Artificial Sequence
  USH2A-617 gRNA targeting domain
agugcaucugcaagcccaaug

SEQ ID NO: 921 - RNA, 24 nt, Artificial Sequence
  USH2A-618 gRNA targeting domain
gggagacagugcaauaaauguuug

SEQ ID NO: 922 - RNA, 23 nt, Artificial Sequence
  USH2A-619 gRNA targeting domain
ggagacagugcaauaaauguuug

SEQ ID NO: 923 - RNA, 22 nt, Artificial Sequence
  USH2A-620 gRNA targeting domain
gagacagugcaauaaauguuug

SEQ ID NO: 924 - RNA, 21 nt, Artificial Sequence
  USH2A-621 gRNA targeting domain
agacagugcaauaaauguuug

SEQ ID NO: 925-927 - skipped (3 entries)

SEQ ID NO: 928 - RNA, 17 nt, Artificial Sequence
  USH2A-263 gRNA targeting domain
cacuacacugcccagag

SEQ ID NO: 929 - RNA, 17 nt, Artificial Sequence
  USH2A-266 gRNA targeting domain
aaaaggugaggauggga

SEQ ID NO: 930 - RNA, 17 nt, Artificial Sequence
  USH2A-260 gRNA targeting domain
cucacauccaacaucau

SEQ ID NO: 931 - RNA, 17 nt, Artificial Sequence
  USH2A-262 gRNA targeting domain
acugucucccuucaaca

SEQ ID NO: 932 - RNA, 20 nt, Artificial Sequence
  USH2A-273 gRNA targeting domain
caggugucacacugaagucc

SEQ ID NO: 933 - RNA, 20 nt, Artificial Sequence
  USH2A-268 gRNA targeting domain
uuaggugugaucauugcaau

SEQ ID NO: 934 - RNA, 20 nt, Artificial Sequence
  USH2A-269 gRNA targeting domain
uugcacuacacugcccagag

SEQ ID NO: 935 - skipped

SEQ ID NO: 936 - RNA, 20 nt, Artificial Sequence
  USH2A-274 gRNA targeting domain
uuuaaaaggugaggauggga

SEQ ID NO: 937 - RNA, 17 nt, Artificial Sequence
  USH2A-267 gRNA targeting domain
uaaauauauuuuaucuu

SEQ ID NO: 938 - RNA, 17 nt, Artificial Sequence
  USH2A-265 gRNA targeting domain
uuggauuuaaauuucuc

SEQ ID NO: 939 - skipped

SEQ ID NO: 940 - RNA, 20 nt, Artificial Sequence
  USH2A-275 gRNA targeting domain
auuuuggauuuaaauuucuc

SEQ ID NO: 941 - DNA, 43 bp, Artificial Sequence
  Donor construct containing USH2A-179 DNA sequence
  misc_feature (11)..(30): USH2A-179 (DNA)
acttttatgggttagatgtcaccaattgtaaagcctgtgactg

What is claimed is:

1. A method of altering a cell comprising contacting the cell with:
   (a) a first gRNA comprising a first targeting domain which is complementary with a first target domain from the USH2A gene, wherein the first targeting domain is configured to provide a first cleavage event selected from a first double strand break and a first single strand break in a region of the USH2A gene which is complementary to a sequence that is the same as, or differs by no more than 3 nucleotides from, a nucleic acid sequence selected from the group consisting of SEQ ID NO:635, SEQ ID NO:392, SEQ ID NO:393, SEQ ID NO:394, SEQ ID NO:395, SEQ ID NO:396, SEQ ID NO:397, SEQ ID NO:398, SEQ ID NO:399, SEQ ID NO:400, and SEQ ID NO:401; and
   (b) a Cas9 molecule,
   wherein an NHEJ-mediated indel is generated by the first break, resulting in a deletion in the USH2A gene.

2. The method of claim 1, wherein the cell is from a subject suffering from or likely to develop Usher Syndrome or retinitis pigmentosa-39.

3. The method of claim 1, wherein the cell is from a subject having a mutation in the USH2A gene.

4. The method of claim 1, wherein the cell is a photoreceptor cell.

5. The method of claim 1, wherein the contacting is performed ex vivo.

6. The method of claim 5, wherein the contacted cell is returned to the subject's body.

7. The method of claim 1, wherein the contacting is performed in vivo.

8. The method of claim 1, wherein the contacting comprises contacting the cell with a nucleic acid comprising a sequence encoding (a) the first gRNA.

9. The method of claim 1, further comprising contacting the cell with (c) a second gRNA.

10. The method of claim 9, wherein the second gRNA comprises a targeting domain which is complementary with a target domain from the USH2A gene, wherein the second targeting domain is configured to provide a second cleavage event selected from a second double strand break and a second single strand break, within 200 nucleotides of the target position of the guanine deletion at nucleotide position 2299 (2299delG) in the USH2A gene.

11. The method of claim 10, wherein the second cleavage event is in a region of the USH2A gene which is complementary to a sequence that is the same as, or differs by no more than 3 nucleotides from, a nucleic acid sequence selected from the group consisting of SEQ ID NO:635, SEQ ID NO:392, SEQ ID NO:393, SEQ ID NO:394, SEQ ID NO:395, SEQ ID NO:396, SEQ ID NO:397, SEQ ID NO:398, SEQ ID NO:399, SEQ ID NO:400, and SEQ ID NO:401.

12. A method of altering a cell comprising contacting the cell with:
   (a) a first gRNA comprising a first targeting domain which is complementary with a first target domain from the USH2A gene, the first targeting domain comprising a sequence that is the same as, or differs by no more than 3 nucleotides from, a first targeting domain sequence selected from the group consisting of SEQ ID NO:635, SEQ ID NO:392, SEQ ID NO:393, SEQ ID NO:394, SEQ ID NO:395, SEQ ID NO:396, SEQ ID NO:397, SEQ ID NO:398, SEQ ID NO:399, SEQ ID NO:400, and SEQ ID NO:401,
   the first targeting domain configured to provide a cleavage event selected from a first double strand break and a first single strand break, in the USH2A gene; and
   (b) a Cas9 molecule.

13. The method of claim 12, wherein the cell is from a subject suffering from or likely to develop Usher Syndrome or retinitis pigmentosa-39.

14. The method of claim 12, wherein the cell is from a subject having a mutation in the USH2A gene.

15. The method of claim 12, wherein the cell is a photoreceptor cell.

16. The method of claim 12, wherein the contacting is performed ex vivo.

17. The method of claim 14, wherein the contacted cell is returned to the subject's body.

18. The method of claim 12, wherein the contacting is performed in vivo.

19. The method of claim 12, wherein the contacting comprises contacting the cell with a nucleic acid comprising a sequence encoding (a) the first gRNA.

20. The method of claim 12, further comprising contacting the cell with (c) a second gRNA.

21. The method of claim 20, wherein the second gRNA comprises a targeting domain which is complementary with a target domain from the USH2A gene, wherein the second targeting domain is configured to provide a cleavage event selected from a second double strand break and a second single strand break, within 200 nucleotides of the target position of the guanine deletion at nucleotide position 2299 (2299delG) in the USH2A gene.

22. The method of claim 20, wherein the second targeting domain comprises a sequence that is the same as, or differs by no more than 3 nucleotides from, a second targeting domain sequence selected from the group consisting of SEQ ID NO:635, SEQ ID NO:392, SEQ ID NO:393, SEQ ID NO:394, SEQ ID NO:395, SEQ ID NO:396, SEQ ID NO:397, SEQ ID NO:398, SEQ ID NO:399, SEQ ID NO:400, and SEQ ID NO:401.

* * * * *